US007189549B2

(12) United States Patent
Hutchinson et al.

(10) Patent No.: US 7,189,549 B2
(45) Date of Patent: Mar. 13, 2007

(54) RECOMBINANT POLYNUCLEOTIDES ENCODING PRO-GELDANAMYCIN PRODUCING POLYKETIDE SYNTHASE AND ACCESSORY PROTEINS, AND USES THEREOF

(75) Inventors: Richard C. Hutchinson, San Mateo, CA (US); Ralph C. Reid, San Rafael, CA (US); Zhihao Hu, Castro Valley, CA (US); Andreas Rascher, San Francisco, CA (US); Andreas Schirmer, Hayward, CA (US); Robert McDaniel, Palo Alto, CA (US)

(73) Assignee: Kosan Biosciences, Inc., Hayward, CA (US)

( * ) Notice: Subject to any disclaimer, the term of this patent is extended or adjusted under 35 U.S.C. 154(b) by 260 days.

(21) Appl. No.: 10/461,194

(22) Filed: Jun. 13, 2003

(65) Prior Publication Data
US 2004/0077058 A1 Apr. 22, 2004

Related U.S. Application Data

(63) Continuation-in-part of application No. 10/212,962, filed on Aug. 5, 2002, now Pat. No. 6,872,715.

(60) Provisional application No. 60/433,130, filed on Dec. 13, 2002, provisional application No. 60/420,820, filed on Oct. 24, 2002, provisional application No. 60/415,326, filed on Sep. 30, 2002, provisional application No. 60/395,275, filed on Jul. 12, 2002, provisional application No. 60/393,929, filed on Jul. 3, 2002, provisional application No. 60/389,255, filed on Jun. 14, 2002.

(51) Int. Cl.
*C12N 9/02* (2006.01)
*C12N 9/10* (2006.01)
*C12N 15/53* (2006.01)
*C12N 15/54* (2006.01)
*C12N 15/74* (2006.01)

(52) U.S. Cl. ............... 435/190; 435/193; 435/69.7; 435/252.35; 435/320.1; 536/23.2

(58) Field of Classification Search ............... None
See application file for complete search history.

(56) References Cited

U.S. PATENT DOCUMENTS

| | | | |
|---|---|---|---|
| 5,672,491 A | 9/1997 | Khosla et al. | |
| 5,712,146 A | 1/1998 | Khosla et al. | |
| 5,830,750 A | 11/1998 | Khosla et al. | |
| 5,843,718 A | 12/1998 | Khosla et al. | |
| 5,962,290 A | 10/1999 | Khosla et al. | |
| 6,303,342 B1 | 10/2001 | Julien et al. | |
| 6,399,789 B1 | 6/2002 | Santi et al. | |
| 6,403,775 B1 | 6/2002 | McDaniel | |
| 6,492,562 B1 | 12/2002 | Ashley et al. | |

FOREIGN PATENT DOCUMENTS

| WO | WO 97/02358 A1 | 1/1997 |
|---|---|---|
| WO | WO 98/49315 A2 | 11/1998 |
| WO | WO 03/13430 A2 | 2/2003 |

OTHER PUBLICATIONS

NCBI BLASTP 2.2.14 Database search results, "sequences producing significant alignments" to query sequence (SEQ ID No. 154)(May 1, 2006).
NCBI BLASTP 2.2.14 Database search results, "sequences producing significant alignments" to query sequence (SEQ ID No. 155)(May 1, 2006).
NCBI BLASTP 2.2.14 Database search results, "sequences producing significant alignments" to query sequence (SEQ ID No. 156)(May 1, 2006).
NCBI BLASTP 2.2.14 Database search results, "sequences producing significant alignments" to query sequence (SEQ ID No. 157)(May 1, 2006).
NCBI BLASTP 2.2.14 Database search results, "sequences producing significant alignments" to query sequence (SEQ ID No. 158)(May 1, 2006).
NCBI BLASTP 2.2.14 Database search results, "sequences producing significant alignments" to query sequence (SEQ ID No. 159)(May 1, 2006).
NCBI BLASTP 2.2.14 Database search results, "sequences producing significant alignments" to query sequence (SEQ ID No. 160)(May 1, 2006).
NCBI BLASTP 2.2.14 Database search results, "sequences producing significant alignments" to query sequence (SEQ ID No. 161)(May 1, 2006).
Allen et al., "Cloning and analysis of DNA sequences from *Streptomyces hygroscopicus* encoding geldanamycin biosynthesis," *Mol. Gen. Genet.*, 243(5):593-599 (1994).
August et al., "Biosynthesis of the ansamycin antibiotic rifamycin: deductions from the molecular analysis of the rif biosynthetic gene cluster of *Amycolatopsis mediterranei* S699," *Chem. Biol.*, 5:69-79 (1998).
Deboer et al., "Geldanamycin, a new antibiotic," *J. Antibiot.*, 23:442-447 (1970).
Deboer et al., "The description and antibiotic production of *Streptomyces hygroscopicus var geldanus*," *J. Antibiot.*, 29:1182-1188 (1976).

(Continued)

*Primary Examiner*—Nashaat T. Nashed
*Assistant Examiner*—William W. Moore
(74) *Attorney, Agent, or Firm*—Townsend and Townsend and Crew LLP

(57) ABSTRACT

The invention relates to recombinant polyketide synthase enzymes, polyketide modifying proteins, and other proteins involved in polyketide biosynthesis or function. The invention provides domains of geldanamycin and herbimycin polyketide synthases, polynucleotides that encode such enzymes, and to host cells in which such encoding polynucleotides can be advantageously expressed.

1 Claim, 11 Drawing Sheets

OTHER PUBLICATIONS

Kim et al., "3-Amino-5-hydroxybenzoic acid synthase, the terminal enzyme in the formation of the precursor of mC7N units in rifamycin and related antibiotics," *J. Biol. Chem.*, 273:6030-6040 (1998).

Leistner, E., "Biosynthesis of ansatrienin (mycotrienin) and naphthomycin. Identification and analysis of two separate biosynthetic gene clusters in *Streptomyces collinus* Tu1892," *Eur. J. Biochem.*, 261:98-107 (1999).

McDaniel et al., "Engineered biosynthesis of novel polyketides," *Science*, 262:1546-1550 (1993).

Omura et al., "Herbimycin, a new antibiotic produced by a strain of *Streptomyces*," *J. Antibiot.*, 32:255-261 (1979).

Rascher et al., "Links Cloning and characterization of a gene cluster for geldanamycin production in *Streptomyces hygroscopicus* NRRL 3602," *FEMS Microbiol. Lett.*, 218(2):223-230 (2003).

Yu et al., "The biosynthetic gene cluster of the maytansinoid antitumor agent ansamitocin from *Actinosynnema pretiosum*," *PNAS*, 99:7968-7973 (2002).

Geldanamycin

Reblastatin

Herbimycin A  (R$_1$=OCH$_3$, R$_2$=CH$_3$)
Herbimycin C  (R$_1$=OCH$_3$, R$_2$=H)
Macbecin I  (R$_1$=CH$_3$, R$_2$=CH$_3$)
Macbecin II  = Macbecin I hydroquinone Herbimycin B

TAN 420A

Ansamitocins
(R$_1$=esters)

RECOMBINANT POLYNUCLEOTIDES ENCODING PRO-GELDANAMYCIN PRODUCING POLYKETIDE SYNTHASE AND ACCESSORY PROTEINS, AND USES THEREOF

CROSS REFERENCE TO RELATED APPLICATIONS

This application claims the benefit of U.S. provisional patent application Nos. 60/389,255 (filed Jun. 14, 2002), 60/393,929 (filed Jul. 3, 2002), 60/395,275 (filed Jul. 12, 2002), 60/415,326 (filed Sep. 30, 2002), 60/420,820 (filed Oct. 24, 2002), 60/433,130 (filed Dec. 13, 2002), and is a Continuation-in-Part of U.S. patent application No. 10/212,962 (filed Aug. 5, 2002) now U.S. Pat. No. 6,872,715. The entire contents of each of these applications is incorporated herein by reference.

REFERENCE TO SEQUENCE LISTING

The appended sequence listing is part of, and incorporated into, the specification.

FIELD OF THE INVENTION

The present invention relates to the fields of molecular biology, chemistry, recombinant DNA technology, medicine, animal health, and agriculture.

BACKGROUND OF THE INVENTION

Polyketides represent a large family of diverse compounds synthesized from 2 carbon units through a series of condensations and subsequent modifications. Polyketides occur in many types of organisms including fungi and mycelial bacteria, in particular the actinomycetes. An appreciation for the wide variety of polyketide structures and for their biological activities may be gained upon review of the extensive art, for example, published International Patent Specification WO 95/08548; U.S. Pat. Nos. 5,672,491 and 6,303,342; Fu et al., 1994, *Biochemistry*, 33:9321–26; McDaniel et al., 1993, *Science*, 262:1546–50; and Rohr, 1995, *Angew. Chem. Int. Ed. Engl.* 34:881–88.

Polyketides are synthesized in nature by polyketide synthases ("PKS"). These synthase enzymes are complexes of multiple enzyme activities. Two major types of PKS are known and differ in their mode of synthesis. These are commonly referred to as Type I or "modular" and Type II "iterative." The Type I or modular PKSs, as commonly found in bacteria but not in fungi, comprise a set of separate catalytic active sites; the portion of the protein that encompasses each active site region is termed a "domain", and a set thereof is termed a "module". One module exists for each cycle of carbon chain elongation and modification. FIG. 9 of aforementioned WO95/08548 depicts a typical Type I PKS, in this case 6-deoxyerythronolide B synthase ("DEBS") which is involved in the production of erythromycin. Six separate modules, each catalyzing a round of condensation and modification of a 3-carbon unit, are present in DEBS. The number and type of catalytic domains that are present in each module varies based on the needed chemistry, and the total of 6 modules is provided on 3 separate polypeptides (designated DEBS-1, DEBS-2, and DEBS-3, with 2 modules per each polypeptide). Each of the DEBS polypeptides is encoded by a separate open reading frame (gene), see Caffrey et al., 1992, *FEBS Letters*, 304:205. DEBS provides a representative example of a modular Type I PKS. In DEBS, modules 1 and 2 reside on DEBS-1, modules 3 and 4 on DEBS-2, and modules 5 and 6 on DEBS-3, wherein module 1 is defined as the first module to act on the growing polyketide backbone, and module 6 the last.

The minimal PKS module is typified by module 3 of DEBS which contains a ketosynthase ("KS") domain, an acyltransferase ("AT") domain, and an acyl carrier protein ("ACP") domain. These three enzyme activities are sufficient to activate a 2, 3, or more -carbon extender unit and attach it to the growing polyketide molecule. Additional domains that may be included in a module relate to reactions other than the actual condensation, and include domains for a ketoreductase activity ("KR"), a dehydratase activity ("DH"), and an enoylreductase activity ("ER") and a methyltransferases activity. With respect to DEBS-1, the first module thereof also contains additional AT and ACP domains because that module catalyzes the initial condensation, and so begins with a "loading di domain" (sometimes referred to as a loading module) that contains an AT and ACP, that bind the starter unit. The "finishing" of the 6-deoxyerythronolide molecule is regulated by a thioesterase activity ("TE") in module 6 that catalyzes cyclization of the macrolide ring during release of the product of the PKS.

In PKS polypeptides, the regions that encode enzymatic activities (domains) are separated by linker or "scaffold"-encoding regions. These scaffold regions encode amino acid sequences that space the enzymatic activities (domains) at the appropriate distances and assure the correct order of modules in the PKS. Thus, these linker regions collectively can be considered to encode a scaffold into which the various domains (and thus modules) are placed in a particular order and spatial arrangement. Generally, this organization permits PKS domains of different or identical substrate specificities to be substituted (usually at the level of encoding DNA) from other PKS by various available methodologies. Thus, there is considerable flexibility in the design of a new PKS to produce a novel polyketide. An additional level of structural complexity in the resultant polyketides may be introduced by subsequent P450 oxidation, methylation, glycosylation or other enzymes that catalyze post-PKS reactions.

Geldanamycin is a polyketide produced by a modular PKS and was the first of four benzoquinone ansamycins isolated from microorganisms (see FIG. 1) to have been evaluated extensively as an antitumor drug. Although originally discovered by screening microbial extracts for antibacterial and antiviral activity [DeBoer, et al. (1970), Sasaki, et al. (1970); full citations of all references cited herein by the author and year of publication are provided below], geldanamycin was later found to be cytotoxic to tumor cells in vitro [Sasaki et al. (1979)] and to reverse the morphology of cells transformed by the Rous sarcoma virus to the normal state [Uehara et al. (1986)]. Subsequent discoveries of the herbimycins [Omura et al. (1979)], macbecins [Muroi et al. (1980)] and TAN 420A [Shibata et al. (1986)] expanded this class of antitumor natural products. Ansamycins like the ansamitocins are usually included in this class of microbial products. Reblastatin, isolated from the geldanamycin producer, was recently found to have interesting biological activities [Takatsu et al. (2000), Stead et al. (2001)].

Geldanamycin's nanomolar potency and apparent specificity for aberrant protein kinase dependent tumor cells, as well as the discovery that its primary target in mammalian cells is the ubiquitous Hsp90 protein chaperone, has stimulated interest in its development as an antitumor drug

[Neckers et al. (2002); Blagosklonny, 2002]. Severe hepatotoxicity [Supko et al. (1995)] led to its withdrawal from Phase I clinical trials in 1995. Nonetheless, during the 1990's considerable information was obtained about the structure-activity relationships (SAR) of geldanamycin, herbimycin and reblastatin [Neckers et al. (2002), Schnur et al. (1995)]. In late 1999, 17-allylamino-17-desmethoxygeldanamycin entered Phase I clinical trials [Egorin et al. (2001), Wilson et al. (2001), Erlichman et al. (2001)] sponsored by the National Cancer Institute in the US and the Cancer Research Campaign in the UK because this analog had exhibited good in vivo activity [Wilson, et al. (2001), Erlichman, et al. (2001)], better pharmacokinetics and lower toxicity than geldanamycin [Egorin et al. (2001)] during preclinical development. The maximum tolerated dose is 40 mg/m$^2$ [Wilson et al. (2001)], and micromolar serum concentrations are achieved without overt toxicity. Efficacy in inhibiting signal transduction pathways has been demonstrated in peripheral blood lymphocytes.

There is therefore a need for recombinant nucleic acids, host cells, and methods of expressing those nucleic acids in host cells to produce geldanamycin at a commercially useful scale and to make geldanamycin analogs. These and other needs are met by the materials and methods provided by the present invention.

The following articles provide additional background information relating to the invention and are incorporated herein by reference. DeBoer et al. "Geldanamycin, a new antibiotic" *J Antibiot (Tokyo)* (1970) 23:442–7. Sasaki et al. "Geldanamycin. I. Structure assignment" *J Am Chem Soc* (1970) 92:7591–3. Blagosklonny, 2002, "Hsp-90-associated oncoproteins: multiple targets of geldanamycin and its analogs" *Leukemia* 16:455–62. Sasaki et al. "Growth inhibition of virus transformed cells in vitro and antitumor activity in vivo of geldanamycin and its derivatives" *J Antibiot (Tokyo)* (1979) 32:849–51. Uehara et al. "Phenotypic change from transformed to normal induced by benzoquinonoid ansamycins accompanies inactivation of p60src in rat kidney cells infected with Rous sarcoma virus" *Mol Cell Biol* (1986) 6:2198–206. Omura et al. "Herbimycin, a new antibiotic produced by a strain of Streptomyces." *J Antibiot (Tokyo)* (1979) 32:255–61. Iwai et al. "Herbimycin B, a new benzoquinonoid ansamycin with anti-TMV and herbicidal activities" *J Antibiot (Tokyo)* (1980) 33:1114–9. Muroi et al. "Macbecins I and II, new antitumor antibiotics. II. Isolation and characterization" *J Antibiot (Tokyo)* (1980) 33:205–12. Shibata et al. "The structure and cytocidal activity of herbimycin C." *J Antibiot (Tokyo)* (1986) 39:1630–3. Takatsu et al. "Eblastatin, a novel benzenoid ansamycin-type cell cycle inhibitor." *J. Antibiot.* (2000) 53:1310–1312. Stead et al. "Discovery of novel ansamycins possessing potent inhibitory activity in a cell-based oncostatin M signalling assay. *J. Antibiot (Tokyo)* 53:657–663. Neckers, L. "Hsp90 inhibitors as novel cancer chemotherapy agents." *Tr. Molec. Med.* (2002) 8:S55–S61. Supko et al. "Preclinical pharmacologic evaluation of geldanamycin as an antitumor agent." *Cancer Chemother Pharmacol* (1995) 36:305–15. Schnur, et al. "erbB-2 Oncogene inhibition by geldanamycin derivatives: synthesis, mechanism of action, and structure-activity relationships." *J. Med. Chem.* (1995) 38:3813–20. Egorinet et al. "Plasma pharmacokinetics and tissue distribution of 17-(allylamino)-17-demethoxygeldanamycin (NSC 330507) in CD2F1 mice." *Cancer Chemother Pharmacol* (2001) 47:291–302. Wilson et al. "Phase I pharmacologic study of 17-AAG in adult patients with advanced solid tumors." *Amer Soc of Clin Oncol,* (2001) Abstract 325; Erlichman et al. "A phase I trial of 17-AAG in patients with advanced cancer." *Proceedings of the AACR* (2001) Abstract. Guo J, Frost J W. "Biosynthesis of 1-deoxy-1-imino-D-erythrose 4-phosphate: (2002). A defining metabolite in the aminoshikimate pathway." (2002) *J Am Chem Soc.* 124, 528–9. Yu et al. (2002). "The biosynthetic gene cluster of the maytansinoid antitumor agent ansamitocin from *Actinosynnema pretiosum.*" *Proc Natl Acad Sci USA.* 99, 7968–73. August et al. (1998). "Biosynthesis of the ansamycin antibiotic rifamycin: deductions from the molecular analysis of the rif biosynthetic gene cluster of *Amycolatopsis mediterranei* S699." *Chem Biol* 5, 69–79; Leistner E (1999). "Biosynthesis of ansatrienin (mycotrienin) and naphthomycin. Identification and analysis of two separate biosynthetic gene clusters in *Streptomyces collinus* Tu1892." *Eur J Biochem* 261, 98–107; DeBoer C, Dietz A. (1976). "The description and antibiotic production of *Streptomyces hygoscopicus* var. *geldanus.*" *J Antibiot* 29, 1182–8. Kunkel, T. A. *Proc Natl Acad Sci USA* (1985) 82:448. Geisselsoder et al. *BioTechniques* (1987) 5:786. Zoller and Smith, *Methods in Enzymology* (1983) 100:468. Dalbie-McFarland et al. *Proc Natl Acad Sci USA* (1982) 79:6409.

SUMMARY OF THE INVENTION

In one aspect, the invention relates to polyketide synthases (PKSs) that produce progeldanamycin, and polynucleotides encoding domains, modules and proteins of such synthases. The structure, sequences and characteristics of the geldanamycin PKS gene cluster and herbimycin PKS gene cluster are disclosed, along with other genes and proteins that participate in polyketide biosynthesis or have other functions. The geldanamycin PKS gene cluster was cloned from *S. hygroscopicus* var. *geldanus* NRRL 3602 and, in one embodiment of the invention, is encoded in SEQ ID NO:1. The herbimycin PKS gene cluster sequence was cloned from *S. hygroscopicus* AM-3672 and, in one embodiment of the invention, is encoded in SEQ ID NO:2.

In one aspect, the invention provides a method of producing a polyketide by culturing a cell under conditions under which the cell produces the polyketide, wherein the cell comprises a recombinant polynucleotide that hybridises under stringent conditions to the polyketide synthase-encoding region of SEQ ID NO:1 and/or SEQ ID NO:2 and encodes at least one core polyketide synthase protein, and where the cell is unable to make the polyketide in the absence of the recombinant polynucleotide. The recombinant polynucleotide can be an expression vector. In one embodiment the polyketide is pro-geldanamycin, and in related embodiments the cell produces geldanamycin or herbimycin. In one embodiment, the cell is not a Streptomyces cell. In a related aspect, the invention provides a recombinant host cell (e.g., which may be a other than a Streptomyces cell) comprising one or more expression vectors that drive expression of polyketide synthase enzymes capable of making pro-geldanamycin in the cell, where the host cell produces progeldanamycin and where the host cell does not produce progeldanamycin in the absence of the expression vector(s).

In another aspect the invention provides a recombinant DNA molecule encoding a domain of a geldanamycin polyketide synthase (PKS) or a herbimycin PKS. In one embodiment, the recombinant DNA molecule encodes one or more modules or polypeptides (open reading frames) of a chimeric PKS. The recombinant DNA molecule can encode a module of geldanamycin PKS and may comprise one or more open reading frames (ORFs) selected from gdmAI, gdmAII and gdmAIII. In an embodiment, the recombinant DNA molecule differs from the corresponding region of native geldanamycin PKS by inactivation of at least one geldanamycin PKS domain. The recombinant DNA molecule can encode a module of a herbimycin PKS and may comprise one or more ORFs selected from hbmAI, hbmAII and hbmAIII. In an embodiment, the recombinant DNA molecule differs from the corresponding region of native herbimycin PKS by inactivation of at least one herbimycin PKS domain. In one embodiment, the recombinant DNA molecule hybridizes under stringent conditions to a nucleic acid having a nucleotide sequence of SEQ. ID NO:1 and/or SEQ. ID NO:2. In related embodiments, a recombinant DNA expression vector comprising the DNA molecule operably linked to a promoter (which can be a promoter is derived from a cell other than Streptomyces) is provided.

In another aspects, a recombinant DNA molecule encoding a geldanamycin modification enzyme involved in the conversion of progeldanamycin to geldanamycin or a herbimycin modification enzyme involved in the conversion of proherbimycin to herbimycin is provided.

The invention also provides a host cell comprising a recombinant DNA molecule or vector described above or elsewhere herein. In one embodiment, the host cell is a *S. hygroscopicus* cell. In other embodiments, the host cell is not a *S. hygroscopicus* cell or is not an *S. hygroscopicus* var. *geldanus* NRRL 3602 cell.

The invention further provides a method of producing a polyketide by growing a host cell, as described above or elsewhere herein, under conditions where a polyketide synthesized by a PKS comprising a protein encoded by the recombinant DNA molecule is produced in the cell, optionally, recovering the synthesized polyketide, and optionally chemically modifying the polyketide and/or formulating the polyketide for administration to a mammal.

The invention further provides an isolated polypeptide encoded by a recombinant DNA olecule described above or elsewhere herein, as well as (1) a chimeric PKS that is composed of at least a portion of a geldanamycin PKS and at least a portion of a second PKS for a polyketide other than geldanamycin and (2) a chimeric PKS that is composed of at least a portion of a herbimycin PKS and at least a portion of a second PKS for a polyketide other than herbimycin. In one embodiment, the second PKS is from a narbonolide PKS, an oleandolide PKS, a DEBS PKS or a rapamycin PKS.

In another aspect, the invention provides a method of producing a polyketide comprising by recombinantly modifying a gene in the geldanamycin PKS gene cluster of a *Streptomyces* cell that comprises the gene cluster to produce a recombinant cell, or obtaining a progeny of the recombinant cell, and growing the recombinant cell or progeny under conditions whereby a polyketide other than geldanamycin is synthesized by the cell, optionally, recovering the synthesized polyketide and, optionally, chemically modifying the polyketide and/or formulating the polyketide for administration to a mammal. In one embodiment of this method, the cell is *S. hygroscopicus* var. *geldanus* NRRL 3602. In one embodiment the cell does not produce geldanamycin.

In another aspect, the invention provides a method of producing a polyketide by recombinantly modifying a gene in the herbimycin PKS gene cluster of a *Streptomyces* cell that comprises the gene cluster to produce a recombinant cell, or obtaining a progeny of the recombinant cell, and growing the recombinant cell or progeny under conditions whereby a polyketide other than herbimycin is synthesized by the cell, optionally, recovering the synthesized polyketide cell, and, optionally, chemically modifying the polyketide and/or formulating the polyketide for administration to a mammal. In one embodiment of this method, the cell is *S. hygroscopicus* AM-3672. In one embodiment the cell does not produce herbimycin.

In various embodiments of these methods, the modifying involves (1) substitution of a geldanamycin AT domain with an AT domain having a different specificity; (2) inactivation of a domain, wherein the domain is selected from the group consisting of a KS domain, an AT domain, an ACP domain, a KR domain, a DH domain, and an ER domain; and/or (3) substitution of KS domain, an ACP domain, a KR domain, a DH domain, or an ER domain with a domain having a different specificity.

In another aspect, the invention provides a recombinant DNA molecule comprising one or more open reading frames (ORFs) of SEQ ID NO:3 as well as a host cell comprising the DNA. In one embodiment, the ORF comprises basepairs 5263–6345; 6575–7270; 2427–3224; 1364–2413; 3397–3846; 4058–5224; and 428–1252. In a related embodiment, the invention provides a recombinant DNA expression vector comprising the above-described DNA molecule operably linked to a promoter as well as a host cell comprising the vector.

In one aspect, the present invention provides recombinant nucleic acids encoding polyketide synthases that produce geldanamycin or geldanamycin analogs in host cells.

In an embodiment of the present invention, there are provided polynucleotides that comprise a coding sequence for one or more domains of geldanamycin polyketide synthase. In another embodiment, the polynucleotide also comprises a coding sequence for one or more domains of another polyketide synthase. In another embodiment, a coding sequence for a domain (or portion thereof) of geldanamycin synthase is combined with coding sequence from another PKS to make a novel PKS that produces a polyketide. Expression of such DNAs, in suitable host cells leads to the production of synthases capable of producing useful polyketides.

Accordingly, there is provided a recombinant PKS wherein at least 10, 15, 20, or more consecutive amino acids in one or more domains of one or more modules thereof are derived from one or more domains of one or more modules of geldanamycin polyketide synthase. Preferably at least an entire domain of a module of geldanamycin synthase is included. Representative geldanamycin PKS domains useful in this aspect of the invention include, for example, KR, DH, ER, AT, ACP and KS domains. In one embodiment of the invention, the PKS is assembled from polypeptides encoded by DNA molecules that comprise coding sequences for polyketide synthase domains, wherein at least one encoded domain corresponds to a domain of geldanamycin polyketide synthase. In such DNA molecules, the coding sequences are operably linked to control sequences so that expression therefrom in host cells is effective.

In another embodiment of the present invention, there is provided a PCR based method to rapidly query the genomic DNA for the presence of type I modular PKS genes, then the number of these genes and their individual characteristics can be established by DNA sequence and bioinformatics analysis of short PKS gene amplimers. This method of the present invention is more reliable and informative than methods involving DNA hybridization, and much less costly than approaches based on whole genome sequencing. This method of the present invention was applied to identify the PKS and tailoring enzymes of the geldanamycin PKS and the genes responsible for the biosynthesis of the ansamycin and geldanamycin starter unit AHBA (3-amino-5-hydroxy benzoic acid).

Accordingly there are provided recombinant polynucleotides that comprise a coding sequence for one or more domains of the geldanamycin starter unit AHBA synthetic enzymes. Expression of such DNAs, in suitable host cells leads to the production of the AHBA starter unit.

BRIEF DESCRIPTION OF THE DRAWINGS

FIG. 2 shows the functions and products of the geldanamycin and herbimycin synthases.

FIG. 3 shows PKS gene clusters and flanking genes.

DETAILED DESCRIPTION OF THE INVENTION

Definitions and Methods

Figure 1:
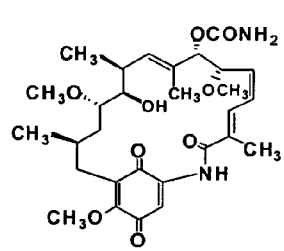
FIG. 1 shows the structure of naturally occurring benzoquinone ansamycins, including geldanamycin and herbimycins A–C.
Figure 1:
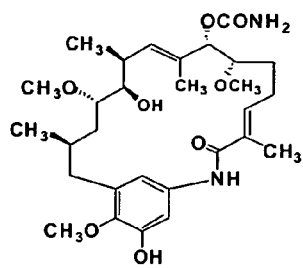
Figure 1:
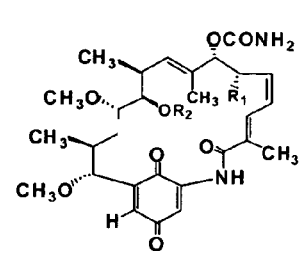
Figure 1:
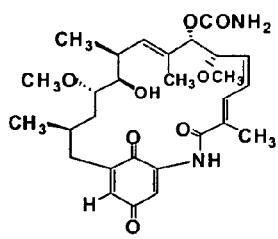
Figure 1:
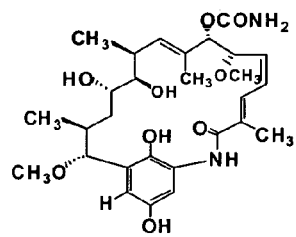
Figure 1:
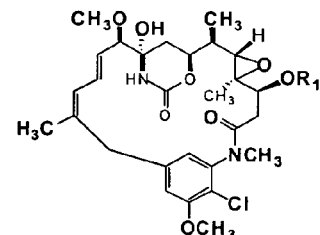

This section provides definitions of selected terms and abbreviations used in this disclosure, as well as resources useful in the practice of the invention. Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art.

As used herein, the terms "tailoring enzyme" and "modification enzyme" are used interchangably and mean an enzyme that modifies the product of a PKS (e.g., progeldanamycin). Exemplary tailoring proteins include oxygenases, glycosyl- and methyltransferases, acyltransferases, halogenases, cyclases, aminotransferases, hydroxylases, and others known in the art.

As used herein, "core" polyketide synthase genes are genes encoding the loading and extendor modules of the PKS. The "core PKS" genes in the geldanamycin PKS cluster are gdmAI, gdmAII, and gdmAIII. The "core PKS" genes in the herbimycin PKS cluster are hbmAI, hbmAII, and hbmAIII. As used herein, a "core" polyketide synthase protein is a protein encoded by a core PKS gene. As used herein, a "polyketide synthase-encoding region" of a polynucleotide refers to the region encoding the core PKS genes.

As used herein, "polyketide synthase biosynthetic gene cluster" refers generally to section of the chromosome comprising the core PKS genes and other genes that play a role in polyketide biosynthesis.

As used herein, a PKS "accessory" protein is a protein, other than a PKS protein, that plays a role in the biosynthesis, modification, or activity of a polyketide. Exemplary accessory proteins include tailoring enzymes, enzymes involved in biosynthesis of polyketide starter units (e.g., AHBA) or extender units (e.g., malonate, 2-methymalonate and 2-methoxymalonate), CoA-ligases, and transcription regulatory proteins. In general, genes encoding accessory proteins are named "gdm_" or "hdm_."

As used herein, PKS "ancillary" proteins refers to proteins disclosed herein that are encoded in the *S. hygroscopicus* genome by genes located near the geldanamycin or herbimycin PKS gene clusters that are not accessory proteins or PKS proteins. In general, genes encoding ancillary proteins are named "ORF_."

It will be appreciated that the terms "gene cluster," "accessory protein," and "ancillary proteins" are used for convenience and are not intended to precisely define the function of a gene or protein.

As used herein an "active fragment" of a polypeptide or domain (or a polynucleotide encoding a polypeptide) has the activity of polypeptide or domain from which it is derived, when intergrated into an appropriate PKS framework using methods known in the art.

As used herein the term "geldanamycin" sometimes refers to "progeldanamycin," as will be clear from context.

As used herein the term "recombinant" refers to a polynucleotide synthesized or otherwise manipulated in vitro, or to methods of using recombinant polynucleotides to produce gene products in cells or other biological systems. Thus, a "recombinant" polynucleotide is defined either by its method of production or its structure. In reference to its method of production, the process is use of recombinant nucleic acid techniques, e.g., involving human intervention in the nucleotide sequence, typically selection or production. Alternatively, a recombinant polynucleotide can be a polynucleotide made by generating a sequence comprising fusion of two fragments which are not naturally contiguous to each other, but is meant to exclude products of nature. Thus, for example, products made by transforming cells with any non-naturally occurring vector is encompassed, as are polynucleotides comprising sequence derived using any synthetic oligonucleotide process, as are polynucleotides from which a region has been deleted. A recombinant polynucleotide can also be a coding sequence that has been modified in vivo using a recombinant oligo or polynucleotide (such as a PKS in which a domain is inactivated by homologous recombination using a recombinant polynucleotide). A "recombinant" polypeptide is one expressed from a recombinant polynucleotide.

As used herein, "isolated" means that a substance is either present in a preparation at a concentration higher than that substance is found in nature or in its naturally occurring state or that the substance is present in a preparation that contains other materials with which the substance is not associated with in nature. As an example of the latter, an isolated geldanamycin PKS protein includes a geldanamycin PKS protein expressed in a *Myxococus* or *Streptomyces lividans* host cell.

"Stringent hybridization conditions" refers to conditions in a range from about 5° C. to about 20° C. or 25° C. below the melting temperature (Tm) of the target sequence and a probe with exact or nearly exact complementarity to the target. As used herein, the melting temperature is the temperature at which a population of double-stranded nucleic acid molecules becomes half-dissociated into single strands. Methods for calculating the Tm of nucleic acids are well known in the art (see, e.g., Berger and Kimmel, 1987, Methods In Enzymology, Vol. 152: Guide To Molecular Cloning Techniques, San Diego: Academic Press, Inc. and Sambrook et al., 1989, Molecular Cloning: A Laboratory Manual, 2nd Ed., Vols. 1–3, Cold Spring Harbor Laboratory). Typically, stringent hybridization conditions are salt concentrations less than about 1.0 M sodium ion, typically about 0.01 to 1.0 M sodium ion at pH 7.0 to 8.3, and temperatures at least about 60° C. for probes greater than 50 nucleotides. As noted, stringent conditions may also be achieved with the addition of destabilizing agents such as formamide, in which case lower temperatures may be employed.

The term substantially identical or homologous or similar varies with the context as understood by those skilled in the relevant art and generally means at least 70%, preferably means at least 80%, more preferably at least 90%, and most preferably at least 95% identity. To determine identity, optimal alignment of sequences for comparison can be conducted, e.g., by the local homology algorithm of Smith & Waterman, 1981, *Adv. Appl. Math.* 2:482, by the search for similarity method of Pearson & Lipman, 1988, *Proc. Natl. Acad. Sci. USA* 85:2444, using the CLUSTAL W algorithm of Thompson et al., 1994, *Nucleic Acids Res* 22:467380, by computerized implementations of these algorithms (GAP, BESTFIT, FASTA, and TFASTA in the Wisconsin Genetics Software Package, Genetics Computer Group, 575 Science Dr., Madison, Wis. The BLAST algorithm (Altschul et al., 1990, *Mol. Biol.* 215:403–10) for which software may be obtained through the National Center for Biotechnology Information (http://www.ncbi.nlm.nih.gov/) can also be used. When using any of the aforementioned algorithms, the default parameters for "Window" length, gap penalty, etc., are used.

As used herein, "substantially identical" to a product means sufficiently similar so that the property of interest is sufficiently unchanged so that the substantially identical product can be used in place of the product.

As used herein, "vector" refers to polynucleotide elements that are used to introduce recombinant nucleic acid into cells for either expression or replication. Selection and use of such vehicles is routine in the art. An "expression vector" includes vectors capable of expressing DNAs that are operatively linked with regulatory sequences, such as promoter regions. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

The following abbreviations are used in this disclosure: 1) ACP, acyl carrier protein; 2) Aden, adenylation; 3) AT, acyltransferase; 4) DH, dehydratase; 5) ER, enoylreductase; 6) KR, ketoreductase; 7) KS, ketosynthase; 8) LDD, loading didomain; 9) NRPS, non-ribosomal peptide synthetase; 10) m, malonylCoA; 11) mm, 2-methylmalonylCoA; 12) moxm, 2-methoxymalonyl-ACP; 13) mod, module; 14) CT carbamoyltransferase; 15) PKS, polyketide synthase; 16) AHBA, 3-amino-5-hydroxy benzoic acid. The following convention is used to refer to domains in a PKS: the number following an abbreviation for a PKS domain refers to the module from which that domain originated. For example, "AT2" refers to the AT domain of module 2. When refering to plasmids, "periods" and "hyphens" are sometimes used interchangably (e.g., pKOS205-110-12 and pKOS205-110:12 are the same).

The practice of the present invention will employ, unless otherwise indicated, conventional techniques of molecular biology (including recombinant techniques), microbiology, cell biology, biochemistry, nucleic acid chemistry, and immunology, which are within the skill of the art. Such techniques are explained fully in the literature, such as *Current Protocols in Molecular Biology* (F. M. Ausubel et al., eds., 1987, including supplements through 2001); *Molecular Cloning: A Laboratory Manual,* third edition (Sambrook and Russel, 2001); PCR: *The Polymerase Chain Reaction,* (Mullis et al., eds., 1994); *Current Protocols in Immunology* (J. E. Coligan et al., eds., 1999, including supplements through 2001). Methods for the genetic manipulation of *Streptomyces* are described in Kieser et al, 2000, "Practical *Streptomyces* Genetics," The John Innes Foundation, Norwich.

DESCRIPTION OF THE INVENTION

Figure 2A:
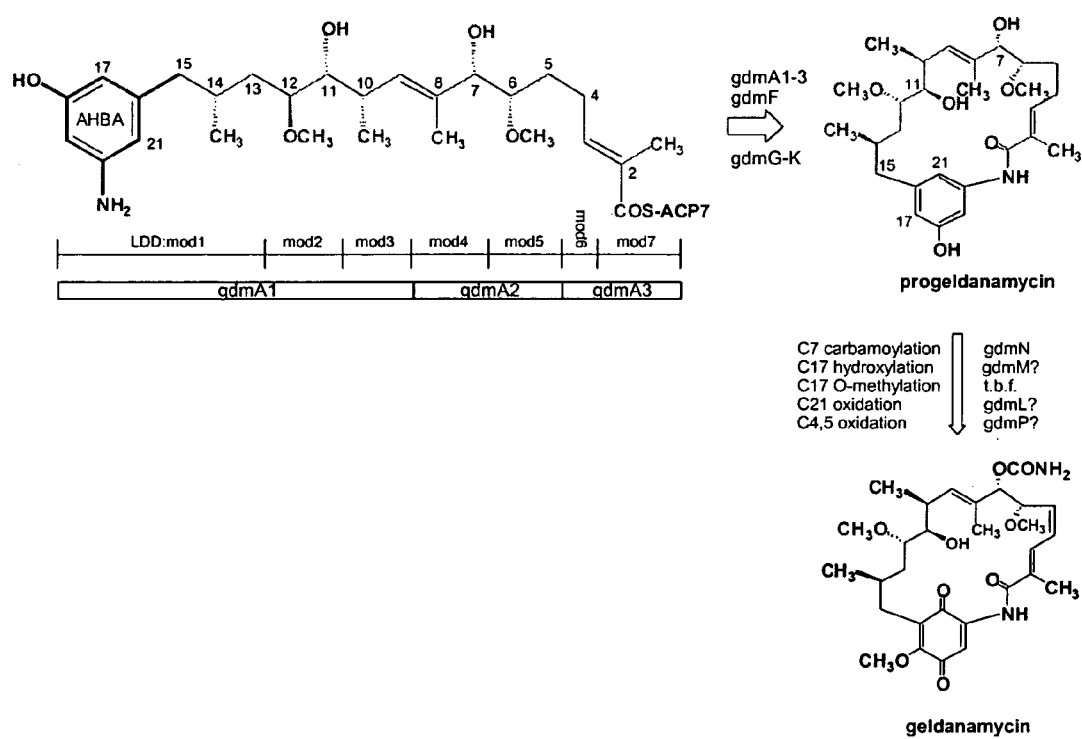
FIG. 2A shows the predicted functions and product of the PKS for geldanamycin biosynthesis. The schematic shows the enzyme-bound product assembled from AHBA and carbon chain extender substrates malonyl-CoA, 2-methoxymalonate and 2-methylmalonyl-CoA by the PKS modules indicated beneath the product structure. Progeldanamycin, produced by the PKS from the 3-amino-5-hydroxybenzoic acid starter unit (AHBA) is converted to geldanamycin by three oxidations, O-methylation, and O-carbamoylation. Panel A shows reduction of the unusual α-methoxy C=C during the second carbon chain extension cycle. Panel B shows creation of the 4,5 cis C=C by oxidation of the saturated system after formation of the ansamycin framework.

Geldanamycin and herbimycin are structurally related polyketides produced by *Streptomyces hygroscopicus*. Geldanamycin was originally identified as a product of *S. hygroscopicus* var. *geldanus* NRRL 3602, and herbimycin was first identified in *S. hygroscopicus* AM-3672. FIG. 2A and FIGURE B show the predicted synthetic pathways for geldanamycin and herbimycin. The geldanamycin polyketide synthase (in *S. hygroscopicus* var. *geldanus* NRRL 3602) and the herbimycin polyketide synthase (in *S. hygroscopicus* AM-3672) produce identical polyketide products, referred to as progeldanamycin or proherbimycin. As a result of post-PKS processing, herbimycin differs from geldanamycin by having a methoxy group at the C15 position instead of at the C17 position, and may also have a hydroxyl or methoxy group at the C11 position.

Given the valuable pharmaceutical properties of geldanamycin and other ansamycins, means to produce pharmaceutically useful quantities of this and related polyketides are useful. The genes encoding the geldanamycin and herbimycin polyketide synthases, as well as genes encoding tailoring enzymes, biosynthetic proteins, regulatory proteins, and other polypeptides have now been cloned, sequenced, and characterized. This information, along with the disclosure below, provides new methods for expressing PKS enzymes and polyketide modification enzymes derived in whole and in part from the geldanamycin and herbimycin gene clusters in recombinant host cells, resulting in the biosynthesis of progeldanamycin, geldanamycin, herbimycins, derivatives and analogs of progeldanamycin, geldanamycin and herbimycin, and other polyketides in host cells. Various aspects of the invention are described in detail in the following sections.

Figure 3A:
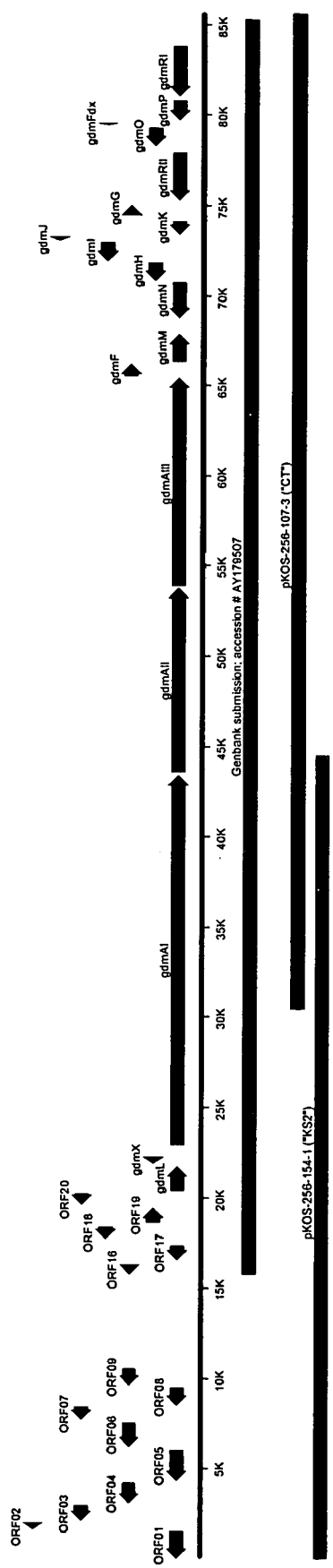
FIG. 3A is a schematic of BAC clones pKOS256-154-1 (KS) and pKOS-256-107-3 (CT) encompassing the geldanamycin PKS gene cluster with flanking genes.
Figure 3B:
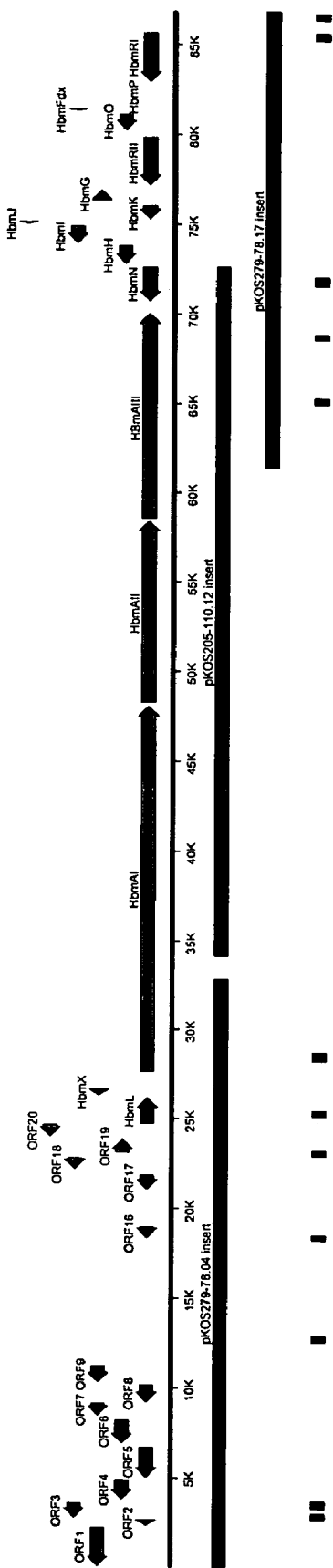
FIG. 3B shows is a schematic of BAC clones pKOS279-78.04, pKOS279-78.17, and pKOS205-110.12, encompassing the herbimycin PKS gene cluster with flanking genes.

The geldanamycin and herbimycin PKS gene clusters are similar at both the sequence and organizational levels (see FIG. 3A and FIG. 3B). TABLE 1, below, summarizes the organization of the gene clusters.

The geldanamycin PKS contains seven modules and produces progeldanamycin. As noted above, this ansamycin is formed from the starter unit 3-amino-5-hydroxybenzoic acid (AHBA) and three different α-carboxy acid chain extender units: malonate, 2-methymalonate and 2-methoxymalonate. (AHBA is formed by the products of AHBA-biosynthetic genes of the geldanamycin gene cluster, which are discussed below.) Module 1 of the geldanamycin PKS contains the loading didomain, which is homologous to the corresponding portion of the rifamycin and ansamitocin PKSs, and consists of a domain for activation of AHBA via formation of its thioester and an ACP domain for subsequent attachment of the activated starter unit to the PKS. This module also contains the six domains required for selection of the first chain extender substrate, 2-methylmalonyl-CoA, and its loading onto the ACP1 domain, followed by condensation of the starter and extender unit catalyzed by the KS1 domain, then reduction, dehydration and double bond reduction catalyzed by the KR1, DH1 and ER1 domains acting in sequo. The domain organization and functions of the six other modules in the geldanamycin PKS are listed in FIG. 2A. The AT2 and AT5 domains (of modules 2 and 5) recognize and load 2-methoxymalonate, a comparatively rare substrate in polyketide synthesis whose formation is governed by five genes in the geldanamycin gene cluster that are homologous to the corresponding FK520 and ansamitocin genes (see WO 00/20601). Modules 3, 4 and 7 utilize 2-methylmalonate, and module 6 uses methylmalonate. These six modules also contain KR, DH and/or ER domains that establish the functionality at positions 2, 4, 7, 9, 11 and 13 in the product of the PKS.

Modification of progeldanamycin to produce geldanamycin involves at least four and perhaps five or six enzymatic reactions: C7 carbamoylation; C17 hydroxylation; C17 O-methylation, C21 oxidation, and perhaps either C4,5 desaturation (oxidation) or C4 or C5 hydroxylation plus dehydration. C7 carbamoylation is believed to be carried out by the gdmN gene product. The oxidation steps, including the hydroxylation, are believed to involve the activities of a subset of the gene products of gdmL, gdmM, gdmP (with gdmFdx) and ORF4P450.

Figure 2B:
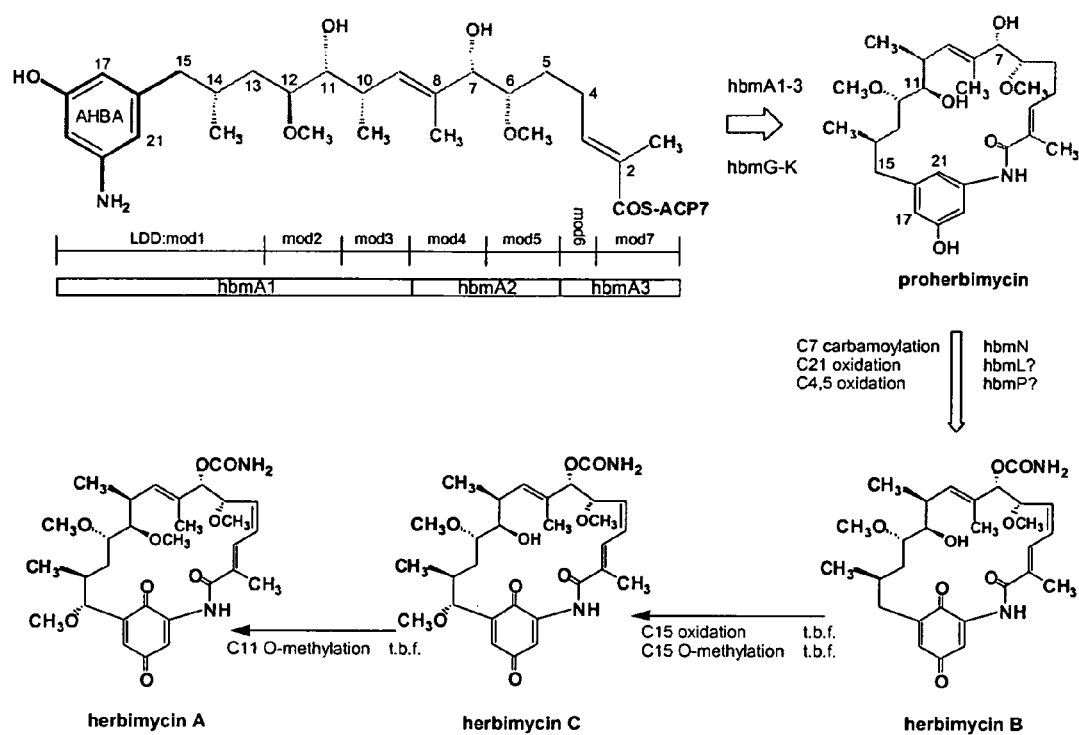
FIG. 2B shows the predicted functions and product of the PKS effecting herbimycin biosynthesis. Proherbimycin, produced by the PKS from the AHBA starter unit, is converted to herbimycin by hydroxylation at C15, O-methylation at C15 and C11, oxidation at C21, and O-carbamoylation at C7.

As noted above, the organization of the herbimycin PKS is similar to that of the geldanamycin gene cluster. The herbimycin PKS contains seven modules and produces progeldanamycin from an AHBA starter unit and malonate, 2-methymalonate and 2-methoxymalonate extender units. Module 1 of the herbimycin PKS contains the loading didomain, and consists of a domain for activation of AHBA via formation of its thioester and an ACP domain for subsequent attachment of the activated starter unit to the PKS. This module also contains the six domains required for selection of the first chain extender substrate, 2-methylmalonyl-CoA, and its loading onto the ACP1 domain, followed by condensation of the starter and extender unit catalyzed by the KS1 domain, then reduction, dehydration and double bond reduction catalyzed by the KR1, DH1 and ER1 domains acting in sequo. The domain organization and functions of the six other modules in the herbimycin PKS are shown in FIG. 2B. The AT2 and AT5 domains (of modules 2 and 5) recognize and load 2-methoxymalonate, a comparatively rare substrate in polyketide synthesis whose formation is governed by five non-PKS genes in the herbimycin gene cluster that are homologous to the corresponding FK520 and ansamitocin genes. Modules 3, 4 and 7 utilize 2-methylmalonate, and module 6 uses malonate. These six modules also contain KR, DH and/or ER domains that establish the functionality at positions 2, 4, 7, 9, 11 and 13 in the product of the PKS.

Modification of progeldanamycin to produce herbimycin involves five enzymatic reactions: C7 carbamoylation, C11 O-methylation, C15 hydroxylation, C15 O-methylation, C21 oxidation, and perhaps either C4,5 desaturation (oxidation) or C4 or C5 hydroxylation plus dehydration. C7 carbamoylation is believed to be carried out by the hbmN gene product. C11 and/or C15 O-methylation may involve the hbmG gene product. The oxidation steps, including the hydroxylation, are believed to involve the activities of a subset of the gene products of hbmL, hbmM, hbmP (with hbmFdx) and ORF4P450.

TABLE 1

PKS AND MODIFYING GENE CLUSTER ORFS OF GELDANAMYCIN (SEQ ID NO: 1) AND HERBIMYCIN (SEQ. ID NO: 2)

| GELDANAMYCIN | | | HERBIMYCIN | |
|---|---|---|---|---|
| ORF BOUNDARIES- | ORF NAME | PROPOSED FUNCTION | ORF NAME | ORF BOUNDARIES- |
| 1–1652 (N-terminus only) | ORF01 | homolog of *S. coelicolor* SC0860c & *S. avermitilis* SAV617; probable cation-transporting ATPase | ORF01 | 71–2359 |
| 1652–2083 | ORF02 | homolog of *S. coelicolor* SC0861c & *S. avermitilis* SAV618; putative secreted protein | ORF02 | 2359–2775 |
| 2070–3053 | ORF03 | homolog of PvcA (*Pseudomonas aeruginosa* PA2234); & of *V. cholerae* VC1949) | ORF03 | 2762–3745 |
| 3057–4313 | ORF04 | P450 | ORF04 | 3757–5013 |
| 4326–6152 | ORF05 | asparagine synthase family | ORF05 | 5026–6852 |
| 6187–7617 | ORF06 | transmembrane efflux protein | ORF06 | 6887–8317 |
| 7723–8526 | ORF07 | homolog of FtrE, *S. coelicolor* SC0998; permease (Fe) | ORF07 | 8437–9240 |
| 8490–9572 | ORF08 | homolog of FtrD, *S. coelicolor* SC0997 | ORF08 | 9204–10286 |
| 9572–10648 | ORF09 | lipoprotein | ORF09 | 10286–11362 |
| 15732–16415 | ORF16 | RhtB family transporter | ORF16 | 18360–19043 |
| 16502–17404 | ORF17 | secreted protein | ORF17 | 21063–21965 |
| 17676–18467 | ORF18 | hydrolase | ORF18 | 22155–22946 |
| 18621–19505 | ORF19 | transcriptional regulator (AraC family) | ORF19 | 23100–23984 |
| 19555–20316 | ORF20 | transcriptional regulator (TetR family) | ORF20 | 24036–24797 |
| 20357–21796 | GdmL | flavin-dependent monooxygenase | HbmL | 24781–26277 |
| 21838–22308 | GdmX | Conserved JadX and MmyY homolog | HbmX | 26325–26795 |
| 22939–43464 | GdmAI Loading Module Module 1 Module 2 Module 3 | PKS modules 0–3 AL0 X ACP0 KS AT DH ER KR ACP KS AT DH ER KR ACP KS AT KR ACP | HbmAI Loading Module Module 1 Module 2 Module 3 | 27677–48139 |
| 43525–53829 | GdmAII Module 4 Module 5 | PKS modules 4–5 KS AT DH KR ACP KS AT KR ACP | HbmAII Module 4 Module 5 | 48197–58492 |
| 53859–65546 | GdmAIII Module 6 Module 7 | PKS modules 6–7 KS AT DH ER KR ACP KS AT DH KR ACP | HbmAIII Module 6 Module 7 | 58519–70125 |
| 6558–66331 | GdmF | amide synthase | none* | |
| 66328–67962 | GdmM | flavin-dependent monooxygenase | none | |
| 68782–70791 | GdmN | carbamoyltransferase | HbmN | 70662–72719 |
| 70853–71965 | GdmH | methoxymalonyl-ACP biosynthesis pathway | HbmH | 72781–73893 |
| 71962–73074 | GdmI | methoxymalonyl-ACP biosynthesis pathway | HbmI | 73890–75002 |
| 73071–73346 | GdmJ | ACP in methoxymalonyl-ACP biosynthesis pathway | HbmJ | 74999–75274 |
| 73343–74209 | GdmK | methoxymalonyl-ACP biosynthesis pathway | HbmK | 75271–76137 |
| 74453–75019 | GdmG | O-methyltransferase in methoxymalonyl-ACP biosynthesis | HbmG | 76381–77037 |
| 75234–78014 | GdmRII | LuxR-type transcriptional regulator | HbmRII | 77137–79917 |
| 78289–79353 | GdmO | AminoDHQ synthase | HbmO | 80193–81257 |
| 79434–79628 | GdmFdx | ferredoxin | HbmFdx | 81334–81528 |
| 79671–80864 | GdmP | P450 | HbmP | 81571–82764 |
| 81021–83909 | GdMRI | LuxR-type transcriptional regulator | HbmRI | 82921–86764 |
| 84662–85375 | ORF22 | Hydrolase | none | |

*"none" indicates the absence of a homolog in this section of the herbimycin genome.

The reader skilled in the art of molecular biology and polyketide biosynthesis will understand, guided by this disclosure, that the polynucleotide sequences and other teachings of the specification and figures make possible a wide variety of applications. These applications include, but are not limited to, applications in which core PKS genes, accessory genes, and ancillary genes are modified and/or expressed using recombinant methods.

The present invention provides, for example, (1) recombinant polynucleotides that comprise sequences encoding a PKS protein, module, domain or fragment thereof, and/or encode an accessory protein or fragment thereof; (2) recombinant polypeptides comprising the sequence of a PKS protein, module, domain or fragment thereof or comprising the sequence of an accessory protein or fragment thereof; and (3) cells comprising a recombinant polynucleotide or polypeptide of the invention. The following sections describe these and other aspects of the invention. However, it will be understood that the embodiments discussed below are for illustration, and are not intended to limit the invention.

In one aspect, the invention provides recombinant polynucleotides that encode a PKS protein, module, domain or fragment thereof, and/or encode an accessory protein or fragment thereof. The polynucleotides of the invention are useful for expression of recombinant proteins (e.g., chimeric PKS proteins), as tools for manipulation of PKS and accessory genes (e.g., vectors for homologous recombination for mutation or deletion of PKS and accessory genes), as probes and primers, and a variety of other uses. It is contemplated that a polynucleotide of the invention can be in any of a variety of forms, depending on its intended function: e.g., integrated into a host cell genome (whether episomal or chromosomal), encoded by a recombinant vector (such as an expression vector), as a linear oligomer (such as a probe or primer), and other forms. In one aspect, the polynucleotide compounds of the invention are used in recombinant procedures for production of desired portions of the geldanamycin or herbimycin synthases. Optionally these portions are fused to, or expressed in conjunction with, all or a portion of a heterologous PKS protein(s), or are modified to change activity. Optionally, recombinant geldanamycin or herbimycin PKS protein, or a chimeric PKS of the invention, is co-expressed with one or more polyketide modification enzymes that modify the polyketide product of the geldanamycin or herbimycin or a chimeric PKS.

In one embodiment, the invention is directed to recombinant materials comprising nucleic acids with nucleotide sequences encoding at least one domain, at least one module, or least one polypeptide encoded by a geldanamycin or herbimycin PKS gene. In one embodiment, purified and isolated DNA molecules are provided that comprise one or more coding sequences for one or more domains or modules of geldanamycin synthase or herbimycin synthase. In one embodiment of the invention, the DNA compounds of the invention comprise a coding sequence for at least two, at least three, at least four, or more, of the domains of the loading module and extender modules 1 through 7, inclusive, of the geldanamycin/herbimycin PKS, or at least one, at least two, or three of the modules of the geldanamycin/herbimycin PKS gene. Examples of such encoded domains include geldanamycin synthase KR, DH, ER, AT, ACP, and KS domains and herbimycin synthase KR, DH, ER, AT, ACP, and KS domains. Examples of such modules include the PKS modules of the geldanamycin PKS and the PKS modules of the herbimycin PKS.

In one embodiment, the invention provides an isolated nucleic acid fragment which hybridizes to a nucleic acid having a nucleotide sequence set forth in the SEQ. ID NO:1, SEQ. ID NO:2, or SEQ. ID NO:3 under stringent conditions. In an embodiment, the nucleic acid fragment comprises, consists or consists essentially of a nucleic acid having a nucleotide sequence set forth in SEQ. ID NO:1, SEQ. ID NO:2, or SEQ. ID NO:3. Encoding sequences for geldanamycin and herbimycin polyketide synthase proteins and assessory proteins may comprise substitutions, additions or deletions relative to SEQ. ID NO:1, SEQ. ID NO:2, or SEQ. ID NO:3 that provide for functionally equivalent molecules. For example, the invention provides, due to the degeneracy of the genetic code, a large number of DNA sequences that encode the amino acid sequences of the domains, modules, and proteins of the geldanamycin and herbimycin PKSs as well as the accessory enzymes. The PKS and accessory genes include those with nucleotide sequences encoding substantially the same amino acid sequences as found in native PKS and accessory genes biosynthetic enzyme proteins, and those encoding amino acid sequences with functionally equivalent amino acids, as well as PKS and accessory genes biosynthetic enzyme derivatives or analogs as described herein. These include but are not limited to nucleotide sequences comprising all or portions of SEQ ID NO:1, 2 or 3 genes that are altered by the substitution of different codons that encode the amino acid residue within the sequence, thus producing a silent change, or in which functionally equivalent amino acid residues are substituted for residues within the sequence resulting in a silent change. For example, one or more amino acid residues within the sequence can be substituted by another amino acid of a similar polarity which acts as a functional equivalent, resulting in a silent alteration. Substitutes for an amino acid within the sequence may be selected from other members of the class to which the amino acid belongs. For example, the nonpolar (hydrophobic) amino acids include alanine, leucine, isoleucine, valine, proline, phenylalanine, tryptophan and methionine. The polar neutral amino acids include glycine, serine, threonine, cysteine, tyrosine, asparagine, and glutamine. The positively charged (basic) amino acids include arginine, lysine and histidine. The negatively charged (acidic) amino acids include aspartic acid and glutamic acid.

In specific embodiments, the biosynthetic nucleic acids encoding PKS and accessory proteins comprise the sequence of SEQ. ID NO:1, SEQ. ID NO:2, or SEQ. ID NO:3, or the coding regions thereof, or nucleotide sequences encoding, in whole or in part, a PKS and accessory genes biosynthetic enzyme protein. The isolated nucleic acids typically consists of at least 25 (continuous) nucleotides, 50 nucleotides, 100 nucleotides, 150 nucleotides, or 200 nucleotides of PKS and accessory genes biosynthetic nucleic acid sequence, or a full-length PKS and accessory genes biosynthetic coding sequence. In another embodiment, the nucleic acids are smaller than 35, 200, or 500 nucleotides in length. Nucleic acids can be single or double stranded. Nucleic acids that hybridize to or are complementary to the foregoing sequences, in particular the inverse complement to nucleic acids that hybridize to the foregoing sequences (i.e., the inverse complement of a nucleic acid strand has the complementary sequence running in reverse orientation to the strand so that the inverse complement would hybridize without mismatches to the nucleic acid strand) are also provided. In specific aspects, nucleic acids are provided which comprise a sequence complementary to (specifically are the inverse complement of) at least 10, 25, 50, 100, or 200 nucleotides or the entire coding region of a PKS and accessory genes biosynthetic gene.

In one important aspect, the invention provides a modified and/or chimeric (also called "hybrid") polyketide synthases. A "modified" PKS is a PKS in which a domain or module has been deleted (including deletion by replacement with a different domain) or mutated to change or eliminate the enzymatic activity of the domain (e.g., inactivation of the domain). Further, reference herein to an "inactivated" domain is intended to encompass a domain that does not function in a PKS because it is partially or completely deleted. As will be apparent to the reader, "modifying" polynucleotides or proteins, as used herein, refers to recombinantly modifying said polynucleotides or proteins, in contrast to, for example, random changes induced by radiation, chemical mutagens, or the like.

A "chimeric" PKS is a PKS protein (or encoding gene) that expresses modules, domains, or portions of domains from two different PKS proteins (either as a fusion protein or by coexpression). Recombinant methods for manipulating modular PKS genes to make hybrid PKS enzymes are described in U.S. Pat. Nos. 5,672,491; 5,843,718; 5,830,750; and 5,712,146; and in WO 98/49315 and WO 97/02358. A number of genetic engineering strategies have been used with DEBS to demonstrate that the structures of polyketides can be manipulated to produce novel natural products, primarily analogs of the erythromycins (see the patent publications referenced supra and Hutchinson, 1998, *Curr Opin Microbiol.* 1:319–329, and Baltz, 1998, *Trends Microbiol.* 6:76–83).

It will be appreciated that a PKS that is chimeric-is also modified and, moreover, that these characterizations are used for convenience and not limitation.

In constructing novel PKS proteins, a number of general principles are known, some of which are summarized here. There are at least six degrees of freedom for constructing a polyketide synthase in terms of the polyketide that will be produced. First, the polyketide chain length will be determined by the number of modules in the PKS. Second, the nature of the carbon skeleton of the PKS will be determined by the specificities of the acyl transferases which determine the nature of the extender units at each position—e.g., malonyl, methyl malonyl, ethyl malonyl, etc. Third, the loading domain specificity will also have an effect on the resulting carbon skeleton of the polyketide. Thus, the loading domain may use a different starter unit, such as acetyl, propionyl, ahba, and the like. Fourth, the oxidation state at various positions of the polyketide will be determined by the dehydratase and reductase portions of the modules. This will determine the presence and location of ketone, alcohol, alkene or alkane substituents at particular locations in the polyketide. Fifth, the stereochemistry of the resulting polyketide is a function of three aspects of the synthase. The first aspect is related to the AT/KS specificity associated with substituted malonyls as extender units, which affects stereochemistry only when the reductive cycle is missing or when it contains only a ketoreductase since the dehydratase would abolish chirality. Also, the specificity of the ketoreductase will determine the chirality of the corresponding hydroxyl group. Also, the enoyl reductase specificity for substituted malonyls as extender units will influence the result when there is a complete KR/DH/ER available. Sixth, the presence and positon of PKS methyl transferase domain(s) in PKS module(s) will determine the presence of methyl functions in the polyketide.

Recombinant methods for manipulating modular PKS genes to make chimeric PKS enzymes are described in U.S. Pat. Nos. 5,672,491; 5,843,718; 5,830,750; and 5,712,146; and in PCT publication Nos. 98/49315 and 97/02358. A number of genetic engineering strategies have been used with DEBS to demonstrate that the structures of polyketides can be manipulated to produce novel natural products, primarily analogs of the erythromycins (see the patent publications referenced supra and Hutchinson, 1998, *Curr Opin Microbiol.* 1:319–329, and Baltz, 1998, *Trends Microbiol.* 6:76–83). In general, these techniques include: (i) deletion or insertion of modules to control chain length, (ii) inactivation of reduction/dehydration domains to bypass beta-carbon processing steps, (iii) substitution of AT domains to alter starter and extender units, (iv) addition of reduction/dehydration domains to introduce catalytic activities, and (v) substitution of ketoreductase KR domains to control hydroxyl stereochemistry. In addition, engineered blocked mutants of DEBS have been used for precursor directed biosynthesis of analogs that incorporate synthetically derived starter units and it is contemplated that the analogous biosynthesis is carried out by a geldanamycin/herbimycin based PKS.

Thus, further aspects of the invention include: (1) encoding DNA for a chimeric PKS that is substantially patterned on a non-geldanamycin producing enzyme, but which includes one or more functional domains or modules of geldanamycin PKS; (2) encoding DNA for a chimeric PKS that is substantially patterned on the geldanamycin PKS, but which includes one or more functional domains or modules of another PKS or NRPS; (3) encoding DNA for a modified PKS that is substantially patterned on a geldanamycin producing enzyme, but in which one or more domains or modules has been deleted or inactivated; (4) methods for making geldanamycin analogs and derivatives; (5) encoding DNA for a chimeric PKS that is substantially patterned on a non-herbimycin producing enzyme, but which includes one or more functional domains or modules of herbimycin PKS; (6) encoding DNA for a chimeric PKS that is substantially patterned on the herbimycin PKS, but which includes one or more functional domains or modules of another PKS or NRPS; (7) encoding DNA for a modified PKS that is substantially patterned on a herbimycin producing enzyme, but in which one or more domains or modules has been deleted or inactivated; and (8) methods for making herbimycin analogs and derivatives.

With respect to items (1) and (5) above, preferred examples include chimeric PKS enzymes wherein the genes for the erythromycin PKS or rapamycin PKS function as accepting genes, and one or more of the above-identified coding sequences for geldanamycin or herbimycin PKS domains or modules are inserted as replacements for domains or modules of comparable function. With respect for (2) and (6) above, a number of other PKS coding sequences that can be used to prepare chimeric domains or molecules are known which are can be used in conjunction with geldanamycin and/or herbimycin PKS encoding sequences to construct a chimeric molecule. A partial list, for illustration and not limitation, includes Avermectin (U.S. Pat. No. 5,252,474; MacNeil et al., 1993, Industrial Microorganisms: Basic and Applied Molecular Genetics, Baltz, Hegeman, & Skatrud, eds. (ASM), pp. 245–256; MacNeil et al., 1992, *Gene* 115: 119–25); Candicidin (FRO008) (Hu et al., 1994, *Mol. Microbiol.* 14: 163–72); Epothilone (U.S. Pat. No. 6,303,342); Erythromycin (WO 93/13663; U.S. Pat. No. 5,824,513; Donadio et al., 1991, *Science* 252:675–79; Cortes et al., 1990, *Nature* 348:176–8); FK-506 (Motamedi et al., 1998, *Eur. J. Biochem.* 256:528–34; Motamedi et al., 1997, *Eur. J. Biochem.* 244:74–80); FK-520 (U.S. Pat. No. 6,503,737; see also Nielsen et al., 1991, *Biochem.* 30:5789–96); Lovastatin (U.S. Pat. No. 5,744,350); Nemadectin (MacNeil et al., 1993, supra); Niddamycin (Kakavas et al., 1997, *J. Bacteriol.* 179:7515–22); Oleandomycin (Swan et al., 1994, *Mol. Gen. Genet.* 242:358–62; U.S. Pat. No. 6,388,099; Olano et al., 1998, *Mol. Gen. Genet.* 259: 299–308); Platenolide (EP Pat. App. 791,656); Rapamycin (Schwecke et al., 1995, *Proc. Natl. Acad. Sci. USA* 92:7839–43); Aparicio et al., 1996, *Gene* 169:9–16); Rifamycin (August et al., 1998, *Chemistry & Biology,* 5: 69–79); Soraphen (U.S. Pat. No. 5,716,849; Schupp et al., 1995, *J. Bacteriology* 177: 3673–79); Spiramycin (U.S. Pat. No. 5,098,837); Tylosin (EP 0 791,655; Kuhstoss et al., 1996, Gene 183:231–36; U.S. Pat. No. 5,876,991). Additional suitable PKS coding sequences remain to be discovered and characterized, but will be available to those of skill (e.g., by reference to GenBank).

In a related embodiment, a domain in a PKS gene is replaced with a domain or domains from a different location (e.g., different module) from same PKS gene. In another embodiment, portions of more than two or more than three PKS genes are combined to produce a chimeric gene and protein.

As noted, construction of such enzymes is most effectively achieved by construction of appropriate encoding polynucleotides. In this example of the invention, it is not necessary to replace an entire domain or module accepting of the PKS with an entire domain or module of geldanamycin PKS, rather peptide subsequences of a PKS domain or module that correspond to a peptide subsequence in an accepting domain or module, or which otherwise provide useful function, may be used as replacements. Accordingly, appropriate encoding DNAs for construction of such chimeric PKS include those that encode at least 5, 10, 15, 20 or more amino acids of a selected geldanamycin domain or module. Those of skill in the art will recognize that all or part of a PKS sequence in a chimeric PKS of the invention need not be isolated from a naturally occurring source. For example, only a small portion of an AT domain determines its specificity. See WO US99/15047, and Lau et al., *Biochemistry* 38:1643–51. The state of the art in DNA synthesis allows the artisan to construct de novo DNA compounds of size sufficient to construct a useful portion of a PKS module or domain. Thus, the desired derivative coding sequences can be synthesized using standard solid phase synthesis methods such as those described by Jaye et al., 1984, *J. Biol. Chem.* 259: 6331, and instruments for automated synthesis are available commercially from, for example, Applied Biosystems, Inc. For purposes of the invention, such synthetic DNA compounds are deemed to be a portion of a PKS.

In addition to providing mutated forms of regions encoding enzymatic activity, regions encoding corresponding activities from different PKS or from different locations in the same PKS can be recovered, for example, using PCR techniques with appropriate primers. By "corresponding" activity encoding regions is meant those regions encoding the same general type of activity—e.g., a ketoreductase activity in one location of a gene cluster would "correspond" to a ketoreductase-encoding activity in another location in the gene cluster or in a different gene cluster; similarly, a complete reductase cycle could be considered corresponding—e.g., KR/DH/ER could correspond to KR alone.

If replacement of a particular target region in a host polyketide synthase is to be made, this replacement can be conducted in vitro using suitable restriction enzymes or can be effected in vivo using recombinant techniques involving homologous sequences framing the replacement gene. One such system involving plasmids of differing temperature sensitivities is described in WO 96/40968.

A particularly useful method for modifying a PKS gene (e.g., making domain substitutions or "swaps") is a RED/ET cloning procedure developed for constructing domain swaps or modifications in an expression plasmid without first introducing restriction sites. The method is related to ET cloning methods (see, Datansko & Wanner, 2000, *Proc. Natl. Acad. Sci. U.S.A.* 97, 6640–45; Muyrers et al, 2000, *Genetic Engineering* 22:77–98) and is described in Example 8, infra. The RED/ET cloning procedure is used to introduce a unique restriction site in the recipient plasmid at the location of the targeted domain. This restriction site is used to subsequently linearize the recipient plasmid in a subsequent ET cloning step to introduce the modification. This linearization step is necessary in the absence of a selectable marker, which cannot be used for domain substitutions. An advantage of using this method for PKS engineering is that restriction sites do not have to be introduced in the recipient plasmid in order to construct the swap, which makes it faster and more powerful because boundary junctions can be altered more easily.

As noted supra, mutations can be introduced into PKS genes such that polypeptides with altered activity are encoded. Polypeptides with "altered activity" include those in Which domains are inactivated or deleted, or in which a mutation changes the substrate specificity of a domain, as well as other alterations in activity. Mutations can be made to the native sequences using any number of conventional techniques. The substrates for mutation can be an entire cluster of genes or only one or two of them; the substrate for mutation may also be portions of one or more of these genes. Techniques for mutation include preparing synthetic oligonucleotides including the mutations and inserting the mutated sequence into the gene encoding a PKS subunit using restriction endonuclease digestion (see, e.g., Kunkel, 1985, *Proc Natl Acad Sci USA* 82:448; Geisselsoder et al., 1987, *BioTechniques* 5:786). Alternatively, the mutations can be effected using a mismatched primer (generally 10–20 nucleotides in length) which hybridizes to the native nucleotide sequence (generally cDNA corresponding to the RNA sequence), at a temperature below the melting temperature of the mismatched duplex. The primer can be made specific by keeping primer length and base composition within relatively narrow limits and by keeping the mutant base centrally located. (See Zoller and Smith, 1983, *Methods in Enzymology* 100:468). Primer extension is effected using DNA polymerase. The product of the extension reaction is cloned, and those clones containing the mutated DNA are selected. Selection can be accomplished using the mutant primer as a hybridization probe. The technique is also applicable for generating multiple point mutations (see, e.g., Dalbie-McFarland et al., 1982, *Proc Natl Acad Sci USA* 79:6409). PCR mutagenesis can also be used for effecting the desired mutations.

It will be apparent that, as described above, a large number of other chimeric and/or modified PKSs can be made. Examples of chimeric polyketide synthases are provided in Examples 6 and 7, below. Example 6 shows substitution of the geldanamycin AT7domain with the AT2 domain of the rapamycin PKS, and Example 7 shows substitution of geldanamycin AT5 domain with the rapamycin AT2 domain. For illustration (and not limitation) several additional examples are provided in the paragraphs A-H, below.

A. Substitution of the Geldanamycin PKS AT1 Domain with an AT Domain Specific for Malonyl-CoA One illustrative recombinant host cell provided by the present invention expresses a recombinant geldanamycin PKS in which the acyltransferase domain in module 1 of the geldanamycin PKS gene is replaced with an AT domain specific for malonyl-CoA instead of 2-methylmalonyl-CoA. The domain substitution is created by introducing a malonyl-CoA specific acyltransferase domain from a heterologous PKS gene, for example from the rapamycin, tylosin, or FK520 PKS genes or the like, into the geldanamycin PKS locus by homologous recombination into a geldanamycin-producing strain, aided by a selectable antibiotic resistance gene, then isolating the recombinants resulting from double crossover events in which the wild-type acyltransferase domain is replaced with one specific for malonyl-CoA. The AT domain of module 1 is encoded by nucleotides 27864 through 28908, approximately, of SEQ ID NO:1. This sequence information together with the methods described in U.S. Pat. Nos. 6,399,789; 6,403,775; and 5,962,290 allows one skilled in the art to construct recombination vectors that result in replacement of the native AT domain of module 1 with an AT domain having a specificity for malonyl-CoA. Suitable examples of AT domains with specificity for malonyl-CoA may be found in the rapamycin PKS genes (modules 2, 5, 8, 9, 11, 12, and 14), as described in U.S. Pat. No. 6,399,789, as well as the tylosin PKS genes (modules 3 and 7) as described in U.S. Pat. No. 5,876,991; the spiramycin genes (modules 1–3 and 7), as described in U.S. Pat. No. 5,945,320; the FK520 genes (modules 3 and 10), as described in WO 00/20601; the pikromycin genes (module 2) as described in WO 99/61599; the narbomycin genes (module 2), as described in U.S. Pat. No. 6,303,767; the avermectin genes (module 2), and others. Fermentation of a host cell comprising the resulting hybrid PKS together with the remaining geldanamycin biosynthetic genes under conditions wherein the native strain produces geldanamycin, provides novel compounds.

B. Mutagenesis of Geldanamycin AT1

One illustrative recombinant host cell provided by the present invention expresses a recombinant geldanamycin PKS in which the AT1 domain of the geldanamycin PKS gene is mutagenized by site-directed mutagenesis to alter the substrate specificity of the AT domain. The AT1 domain can be mutagenized by art-known methods, such as methods described in Reeves et al., "Alteration of the substrate specificity of a modular polyketide synthase acyltransferase domain through site-directed mutagenesis," Biochemistry 2001, 40: 15464–70, and in WO 03/014312. The amino acid sequence Tyr-Ala-Ser-His (SEQ ID NO:81), encoded by nucleotide sequence TAC-GCC-TCC-CAC (SEQ ID NO:82) at positions 56052 to 56063 in SEQ ID NO:1, is mutagenized using methods known to one skilled in the art to generate the mutant amino acid sequence His-Ala-Phe-His (SEQ ID NO:83), for example by mutagensis of the nucleotide sequence to CAC-GCC-TTC-CAC (SEQ ID NO:84) as described in the Reeves et al. reference cited above. Fermentation of a host cell comprising the resulting mutagenized PKS together with the remaining geldanamycin biosynthetic genes under conditions wherein the native strain produces geldanamycin, followed by extraction of the broth and purification provides novel compounds.

C. Substitution of KR Domain for the Reduction Cassette of Geldanamycin PKS Module 6 (DH6+KR6)

One illustrative recombinant host cell provided by the present invention expresses a recombinant geldanamycin PKS in which the coding sequence for the reduction cassette of module 6, which has both DH and KR domains, is replaced with a coding sequence for a reduction cassette that has only a KR domain.

The coding sequence for the reduction cassette of module 6, which has both DH and KR domains, is replaced with a coding sequence for a reduction cassette that has only a KR domain. The reduction cassette is contained in the sequence between the end of the AT domain, at approximately nucleotide position 56663 of SEQ ID NO:1, and the beginning of the ACP domain, at approximately nucleotide position 59886 of SEQ ID NO:1. This sequence information together with the methods described in U.S. Pat. Nos. 6,399,789; 6,403,775; and 5,962,290 allows one skilled in the art to construct recombination vectors that result in replacement of the native reduction cassette of module 6 with a cassette encoding only a KR domain. Suitable examples of cassettes encoding only a KR domain may be found in the erythromycin and rapamycin PKS genes, as described in U.S. Pat. No. 6,399,789. Fermentation of a host cell comprising the resulting hybrid PKS together with the remaining geldanamycin biosynthetic genes under conditions wherein the native strain produces geldanamycin, followed by extraction of the broth and purification provides 4,5-dihydro-5-hydroxy-geldanamycin.

D. Inactivation of DH6

One illustrative recombinant host cell provided by the present invention expresses a recombinant geldanamycin PKS in which the dehydratase domain in module 6 is inactivated by site-specific mutation.

Inactivation of the dehydratase domain in module 6 of the geldanamycin PKS gene by site-specific mutation of the wild-type domain results in production of 4,5-dihydro-5-hydroxygeldanamycin. The DH domain of module 6 is encoded by nucleotides 56663 to 59886, approximately, of SEQ ID NO:1. Two particular sequences may be targeted for mutational inactivation of the DH domain. In one embodiment, the DNA sequence encoding the DH peptide motif His-Val-Ile-Ser-Gly-Ala-Val-Leu-Val-Pro (SEQ ID NO:7), nucleotides 56814 to 56843 of SEQ ID NO:1, is mutated so as to produce a peptide having an amino acid other than histidine at the first position. The CAC codon encoding histidine is mutated, for example to CAA or CAG to encode a glutamine. Fermentation of a host cell comprising the resulting mutagenized PKS together with the remaining geldanamycin biosynthetic genes under conditions wherein the native strain produces geldanamycin, followed by extraction of the broth and purification, provides 4,5-dihydro-5-hydroxy-geldanamycin.

E. Deletion of DH6+ER6

One illustrative recombinant host cell provided by the present invention expresses a recombinant geldanamycin PKS in which a substantial portion of the nucleotide sequence between the end of the AT6 and KR6 domain is deleted.

A portion of the nucleotide sequence in module 6 between the end of the AT domain (approximately nucleotide 56663 of SEQ ID NO:1) and the start of the KR domain (approximately nucleotide 57128 of SEQ ID NO:1) is deleted, resulting in deletion of the dehydratase and enol-reductase domains. This leaves a linker region between the AT and KR domains of approximately 465 amino acids.

F. Reductive Domain Swap

One illustrative recombinant host cell provided by the present invention expresses a recombinant geldanamycin PKS in which the dehydratase domain of module 1 is replaced or inactivated by site-specific mutation.

The reduction cassette in module 1 is encoded by the sequence between the end of the AT domain, at approximately nucleotide position 28908 of SEQ ID NO:1, and the beginning of the ACP domain, at approximately nucleotide position 32133 of SEQ ID NO:1. This sequence information together with the methods described in U.S. Pat. Nos. 6,399,789; 6,403,775; and 5,962,290 allows one skilled in the art to construct recombination vectors that result in replacement of the native reduction cassette of module 1 with a cassette encoding only a KR domain. Suitable examples of cassettes encoding only a KR domain may be found in the erythromycin and rapamycin PKS genes, as described in U.S. Pat. 6,399,789. Fermentation of a host cell comprising the resulting hybrid PKS together with the remaining geldanamycin biosynthetic genes under conditions wherein the native strain produces geldanamycin, followed by extraction of the broth and purification, provides 15-hydroxy-geldanamycin.

G. Inactivation of DH1

One illustrative recombinant host cell provided by the present invention expresses a recombinant geldanamycin PKS in which the dehydratase domain of module 1 is inactivated by site-specific mutation of the wild-type domain.

Inactivation of the dehydratase domain in module 1 of the geldanamycin PKS gene by site-specific mutation of the wild-type domain results in production of 15-hydroxygeldanamycin. The DH domain of module 1 is encoded by nucleotides 28908 to 30378, approximately, of SEQ ID NO:1. Two particular sequences may be targeted for mutational inactivation of the DH domain. In one embodiment, the DNA sequence encoding the DH peptide motif His-Ala-Val-Ser-Gly-Thr-Val-Leu-Leu-Pro (SEQ ID NO: 9), nucleotides 29088 through 29059 of SEQ ID NO:1, is mutated so as to produce a peptide having an amino acid other than histidine at the first position. The CAC codon encoding histidine is mutated, for example to CAA or CAG to encode a glutamine. Fermentation of a host cell comprising the resulting mutagenized PKS together with the remaining geldanamycin biosynthetic genes under conditions wherein the native strain produces geldanamycin, followed by extraction of the broth and purification provides 15-hydroxy-geldanamycin.

H. Inactivation of KS Domain

One illustrative recombinant host cell provided by the present invention expresses a recombinant geldanamycin PKS in which the module 1 KS domain is inactivated by deletion or other mutation. In one version, the inactivation results from a change in the KS domain that renders it incapable of binding substrate (called a KS1° mutation). This inactivation can be accomplished by a mutation in the codon for the active site cysteine that changes the codon to another codon, such as an alanine codon. Preferably the modified KS domain is in translational reading frame with extender modules 1 and 2 of the PKS. The host cells expressing a PKS comprising the protein encoded thereby can be fed or supplied with N-acylcysteamine thioesters of precursor molecules to prepare a polyketide of interest. See U.S. patent application Ser. No. 09/492,773 (published as U.S. Pat. No. 6,492,562) and WO 00/44717.

Examples of compounds that can be produced using geldanamycin-based chimeric PKSs, for illustration and not limitation, are described in WO 03/013430 ("Benzoquinone Ansamycins," published Feb. 20, 2003).

In an aspect, the invention provides chimeric and/or modified polyketide synthases based on the geldanamycin or herbimycin PKSs or containing a portion (e.g., domain) of geldanamycin or herbimycin PKS. Regardless of the naturally occurring PKS gene used as an acceptor, the invention provides libraries of polyketides by generating modifications in, or using a portion of, the geldanamycin or herbimycin PKS so that the protein complexes produced by the cluster have altered activities in one or more respects, and thus produce polyketides other than the natural product of the PKS. Novel polyketides may thus be prepared, or polyketides in general prepared more readily, using this method. By providing a large number of different genes or gene clusters derived from a naturally occurring PKS gene cluster, each of which has been modified in a different way from the native cluster, an effectively combinatorial library of polyketides can be produced as a result of the multiple variations in these activities.

As used herein, a polyketide synthase "derived from" a naturally occurring PKS contains the scaffolding encoded by all the portion of the naturally occurring synthase gene used, contains at least two modules that are functional, and contains mutations, deletions, or replacements of one or more of the activities of these functional modules so that the nature of the resulting polyketide is altered. This definition applies both at the protein and genetic levels. Particularly preferred embodiments include those wherein a KS, AT, KR, DH, NRPS, or ER has been deleted or replaced by a version of the activity from a different PKS or from another location within the same PKS. Also preferred are derivatives where at least one noncondensation cycle enzymatic activity (KR, DH, or ER) has been deleted or wherein any of these activities has been mutated so as to change the ultimate polyketide synthesized.

In one aspect, the invention provides libraries of recombinant cells producing polyketides wherein the polyketides are synthesized by a PKS derived from naturally occurring PKSs. Generally, many members of these polyketide libraries may themselves be novel compounds, and the invention further includes novel polyketide members of these libraries.

Expression vectors containing nucleotide sequences encoding a variety of PKS systems for the production of different polyketides can be introduced by transformation into the appropriate host cells to construct a polyketide library. In one approach, a mixture of such vectors is transformed into the selected host cells and the resulting cells plated into individual colonies and selected for successful transformants. Each individual colony has the ability to produce a particular PKS synthase and ultimately a particular polyketide. Typically, there will be duplications in some of the colonies; the subset of the transformed colonies that contains a different PKS in each member colony can be considered the library. Alternatively, the expression vectors can be used individually to transform hosts, which transformed hosts are then assembled into a library. A variety of strategies might be devised to obtain a multiplicity of colonies each containing a PKS gene cluster derived from the naturally occurring host gene cluster so that each colony in the library produces a different PKS and ultimately a different polyketide. The number of different polyketides that are produced by the library is typically at least four, more typically at least ten, and preferably at least 20, more preferably at least 50, reflecting similar numbers of different altered PKS gene clusters and PKS gene products. The number of members in the library is arbitrarily chosen; however, the degrees of freedom outlined above with respect to the variation of starter, extender units, stereochemistry, oxidation state, and chain length is quite large. The polyketide producing colonies can be identified and isolated using known techniques and the produced polyketides further characterized. The polyketides produced by these colonies can be used collectively in a panel to represent a library or may be assessed individually for some kind of chemical or biological activity.

The libraries can thus be considered at four levels: (1) a multiplicity of colonies each with a different PKS encoding sequence encoding a different PKS cluster but all derived from a naturally occurring PKS cluster; (2) colonies which contain the proteins that are members of the PKS produced by the coding sequences; (3) the polyketides produced; and (4) compounds derived from the polyketides. Of course, combination libraries can also be constructed wherein members of a library derived, for example, from the erythromycin PKS can be considered as a part of the same library as those derived from, for example, the rapamycin PKS cluster.

Colonies in the library are induced to produce the relevant synthases and thus to produce the relevant polyketides to obtain a library of candidate polyketides. The polyketides secreted into the media can be screened for binding to desired targets, such as receptors, signaling proteins, and the like. The supernatants per se can be used for screening, or partial or complete purification of the polyketides can first be effected. Typically, such screening methods involve detecting the binding of each member of the library to a receptor or other target molecule or complex of molecules. Binding can be detected either directly or through a competition assay. Means to screen such libraries for binding are well known in the art. Alternatively, individual polyketide members of the library can be tested against a desired target. In this event, screens wherein the biological response of the target is measured can be included.

In one version, libraries of polyketides are produced by cloning PKS genes as a set of three or more mutually selectable plasmids, each carrying a different wild-type or mutant PKS gene, then introducing all possible combinations of the plasmids with wild-type, mutant, and hybrid PKS coding sequences into the same host (see WO 00/63361 and WO 98/27203).

In aspects of the invention, accessory genes and proteins disclosed herein are used for production of novel polyketides (e.g., by post-PKS tailoring of polyketides), more efficient production of known polyketides (e.g., increased and/or heterologous biosynthesis of a desired polyketide), increased and/or heterologous biosynthesis of PKS substrates (such as AHBA, malonyl-CoA, 2-methoxymalonate and 2-methylmalonyl-CoA), regulation of protein biosynthesis (e.g., transcriptional regulation of genes encoding PKS and accessory proteins, increased and/or heterologous transport of polyketides), drug resistance (e.g., resistance to geldanamycin and/or herbimycin), and other uses. These and other results are accomplished by heterologous expression of one or more accessory proteins and/or inactivation of one or more accessory proteins and/or modification of one or more accessory proteins. Similarly, genes denoted as ancillary genes encode useful proteins and can be expressed and/or modified in a host cell, used for targeting, and the like.

One useful set of accessory proteins are the AHBA biosynthetic proteins described in EXAMPLE 4, infra. The genes encoding these proteins can be expressed alone or in combination with AHBA biosynthetic genes from other sources (see, e.g., Yu et al., 2002 *Proc Natl Acad Sci USA*. 99:7968–73; August et al., 1998 *Chem Biol* 5: 69–79; and Kim et al., 1998, *J. Biol. Chem.* 273:6030–40) to produce AHBA in a heterologous cell. Alternatively, one or more genes in the AHBA synthetic pathway can be inactivated by recombinant means. Such inactivation can be employed, for example, to facilitate production of polyketides modified or that use starter units other than AHBA, such as modified AHBA derivatives or diketides, including polyketides expressed by modified or chimeric PKSs.

Sequences of the geldanamycin (or herbimycin) gene cluster or mutated versions of the geldanamycin gene cluster prepared according to the methods of the invention can be expressed in the native geldanamycin (or herbimycin) producer or in heterologous systems. Methods for heterologous expression of PKS genes and host cells suitable for expression of these genes and production of polyketides are described, for example, in U.S. Pat. Nos. 5,843,718 and 5,830,750; WO 01/31035, WO 01/27306, and WO 02/068613; and U.S. patent application Ser. Nos. 10/087, 451; 60/355,211; and 60/396,513.

Particularly preferred host cells for purposes of the present invention are *Streptomyces, Myxococcus*, and *Saccharopolyspora* host cells. Preferred hosts include fungal systems such as yeast, and procaryotic hosts; mammalian cells could also be used. As disclosed in U.S. Pat. No. 6,033,883, a wide variety of hosts can be used, even though some hosts natively do not contain the appropriate post-translational mechanisms to activate the acyl carrier proteins of the synthases. These hosts can be modified with the appropriate recombinant enzymes to effect these modifications. Suitable host cells include *Streptomyces* spp., *E. coli,* yeast, and other procaryotic hosts which use control sequences compatible with *Streptomyces* spp.

Similarly, host cells can be selected, or engineered, for expression of polyketide biosynthetic activities, such as glycosylatation apparatus (discussed below), amide synthases, (see, for example, U.S. provisional patent application 60/396,513 "Metabolic Pathways For Starter Units in Polyketide Biosynthesis in *E. Coli*"). In one embodiment herbimycin PKS genes are co-expressed with a heterologous amide synthase, such as the synthase encoded by gdmF. In a related embodiment, gdmF is expressed in the herbimycin producer *S. hygroscopicus* AM-3672.

The vectors used to perform the various operations to replace the enzymatic activity in the host PKS genes or to support mutations in these regions of the host PKS genes may be chosen to contain control sequences operably linked to the resulting coding sequences in a manner that expression of the coding sequences may be effected in an appropriate host. If the cloning vectors employed to obtain PKS genes encoding a derived PKS lack control sequences for expression operably linked to the encoding nucleotide sequences, the nucleotide sequences are inserted into appropriate expression vectors. This need not be done individually, but a pool of isolated encoding nucleotide sequences can be inserted into host vectors, the resulting vectors transformed or transfected into host cells and the resulting cells plated out into individual colonies.

Preferred host cells for purposes of selecting vector components for expression vectors of the present invention include fungal host cells such as yeast and procaryotic host cells such as *E. coli* and *Streptomyces*, but mammalian host cells can also be used. Suitable control sequences include those which function in eucaryotic and procaryotic host cells.

Suitable control sequences for single cell cultures of various types of organisms are well known in the art. Control systems for expression in yeast are widely available and are routinely used. Control elements include promoters, optionally containing operator sequences, and other elements depending on the nature of the host, such as ribosome binding sites. Particularly useful promoters for procaryotic hosts include those from PKS gene clusters which result in the production of polyketides as secondary metabolites, including those from Type I or aromatic (Type II) PKS gene clusters. Examples are act promoters, tcm promoters, spiramycin promoters, and the like. However, other bacterial promoters, such as those derived from sugar metabolizing enzymes, such as galactose, lactose (lac) and maltose, are also useful. Additional examples include promoters derived from biosynthetic enzymes such as for tryptophan (trp), the β-lactamase (bla) bacteriophage lambda PL, and T5. In addition, synthetic promoters, such as the tac promoter (U.S. Pat. No. 4,551,433) can be used.

As noted, particularly useful control sequences are those which themselves, or with suitable regulatory systems, activate expression during transition from growth to stationary phase in the vegetative mycelium. The system contained in the plasmid identified as pCK7, i.e., the actI/actIII promoter pair and the actII-ORF4 (an activator gene), is particularly preferred. Particularly preferred hosts are those which lack their own means for producing polyketides so that a cleaner result is obtained. Illustrative control sequences, vectors, and host cells of these types include the modified S. coelicolor CH999 and vectors described in PCT publication WO 96/40968 and similar strains of S. lividans. See U.S. Pat. Nos. 5,672,491; 5,830,750, 5,843,718; and 6,177,262.

Other regulatory sequences may also be desirable which allow for regulation of expression of the PKS sequences relative to the growth of the host cell. Regulatory sequences are known to those of skill in the art, and examples include those which cause the expression of a gene to be turned on or off in response to a chemical or physical stimulus, including the presence of a regulatory compound. Other types of regulatory elements may also be present in the vector, for example, enhancer sequences.

Selectable markers can also be included in the recombinant expression vectors. A variety of marker genes are known which are useful in selecting for transformed cell lines and generally comprise a gene whose expression confers a selectable phenotype on transformed cells when the cells are grown in an appropriate selective medium. Such markers include, for example, genes which confer antibiotic resistance or sensitivity to the plasmid. Alternatively, several polyketides are naturally colored, and this characteristic provides a built-in marker for screening cells successfully transformed by the present constructs.

The various PKS nucleotide sequences, or a mixture of such sequences, can be cloned into one or more recombinant vectors as individual cassettes, with separate control elements or under the control of a single promoter. The PKS subunits or components can include flanking restriction sites to allow for the easy deletion and insertion of other PKS subunits so that hybrid or chimeric PKSs can be generated. The design of such restriction sites is known to those of skill in the art and can be accomplished using the techniques described above, such as site-directed mutagenesis and PCR. Methods for introducing the recombinant vectors of the present invention into suitable hosts are known to those of skill in the art and typically include the use of $CaCl_2$ or other agents, such as divalent cations, lipofection, DMSO, protoplast transformation, and electroporation.

When such DNA molecules are introduced into a host cell and the host cell is cultured under conditions that lead to the expression of the geldanamycin (or herbimycin), or chimeric PKS proteins, geldanamycin (or herbimycin) and/or its analogs or derivatives may be produced. In one embodiment, the expression control sequences are those normally associated with a module of the S. hygroscopicus geldanamycin or herbimycin polyketide synthase gene cluster.

The native, chimeric or modified PKS genes can be expressed in a cell that also expresses other proteins involved in polyketide biosynthesis or modification. These other proteins can be endogenous proteins (normally expressed in the host cell), heterologous recombinant proteins (encoded by a sequence not normally expressed in the host cell), or combinations of both.

In hosts such as yeasts, plants, or mammalian cells that ordinarily do not produce polyketides, it may be necessary to provide, also typically by recombinant means, suitable holo-ACP synthases to convert the recombinantly produced PKS to functionality. Provision of such enzymes is described, for example, in WO 97/13845 and WO 98/27203.

For example and not limitation, the host cell can contain the desosamine, megosamine, and/or mycarose biosynthetic genes, corresponding glycosyl transferase genes, and hydroxylase genes (e.g., picK, megK, eryK, megF, and/or eryF). Methods for glycosylating polyketides are generally known in the art and can be applied in accordance with the methods of the present invention; the glycosylation may be effected intracellularly by providing the appropriate glycosylation enzymes or may be effected in vitro using chemical synthetic means as described herein and in WO 98/49315, incorporated herein by reference. Glycosylation with desosamine, mycarose, and/or megosamine is effected in accordance with the methods of the invention in recombinant host cells provided by the invention. Alternatively and as noted, glycosylation may be effected intracellularly using endogenous or recombinantly produced intracellular glycosylases. In addition, synthetic chemical methods may be employed.

Alternatively, the aglycone compounds can be produced in the recombinant host cell, and the desired modification (e.g., glycosylation and hydroxylation) steps carried out in vitro (e.g., using purified enzymes, isolated from native sources or recombinantly produced) or in vivo in a converting cell different from the host cell (e.g., by supplying the converting cell with the aglycone).

Suitable culture conditions for production of polyketides using the cells of the invention will vary according to the host cell and the nature of the polyketide being produced, but will be know to those of skill in the art. See, for example, WO 98/27203 "Production Of Polyketides In Bacteria And Yeast" and WO 01/83803 "Overproduction Hosts For Biosynthesis Of Polyketides."

The polyketide product produced by host cells of the invention can be recovered (i.e., separated from the producing cells and at least partially purified) using routine techniques (e.g., extraction from broth followed by chromatography).

The compositions, cells and methods of the invention may be directed to the preparation of an individual polyketide or a number of polyketides. The polyketide may or may not be novel, but the method of preparation permits a more convenient or alternative method of preparing it. It will be understood that the resulting polyketides may be further modified to convert them to other useful compounds. For example, an ester linkage may be added to produce a "pharmaceutically acceptable ester" (i.e., an ester that hydrolyzes under physiologically relevant conditions to produce a compound or a salt thereof). Illustrative examples of suitable ester groups include but are not limited to formates, acetates, propionates, butyrates, succinates, and ethylsuccinates.

The polyketide product can be modified by addition of a protecting group, for example to produce prodrug forms. A variety of protecting groups are disclosed, for example, in T. H. Greene and P. G. M. Wuts, Protective Groups in Organic Synthesis, Third Edition, John Wiley & Sons, New York (1999). Prodrugs are in general functional derivatives of the compounds that are readily convertible in vivo into the required compound. Conventional procedures for the selection and preparation of suitable prodrug derivatives are described, for example, in "Design of Prodrugs," H. Bundgaard ed., Elsevier, 1985.

Similarly, improvements in water solubility of a polyketide compound can be achieved by addition of groups containing solubilizing functionalities to the compound or by removal of hydrophobic groups from the compound, so as to decrease the lipophilicity of the compound. Typical groups containing solubilizing functionalities include, but are not limited to: 2-(dimethylaminoethyl)amino, piperidinyl, N-alkylpiperidinyl, hexahydropyranyl, furfuryl, tetrahydrofurfuryl, pyrrolidinyl, N-alkylpyrrolidinyl, piperazinylamino, N-alkylpiperazinyl, morpholinyl, N-alkylaziridinylmethyl, (1-azabicyclo[1.3.0]hex-1-yl) ethyl, 2-(N-methylpyrrolidin-2-yl)ethyl, 2-(4-imidazolyl) ethyl, 2-(1-methyl-4-imidazolyl)ethyl, 2-(1-methyl-5-imidazolyl)ethyl, 2-(4-pyridyl)ethyl, and 3-(4-morpholino)-1-propyl. In the case of geldanamycin analogs, solubilizing groups can be added by reaction with amines, which results in the displacement of the 17-methoxy group by the amine (see, Schnur et al., 1995, "Inhibition of the Oncogene Product p185$^{erbB-2}$ in Vitro and in Vivo by Geldanamycin and Dihydrogeldanamycin Derivatives," *J. Med. Chem.* 38, 3806–3812; Schnur et al., 1995 "erbB-2 Oncogene Inhibition by Geldanamycin Derivatives: Synthesis, Mechanism of Action, and Structure-Activity relationships," *J. Med. Chem.* 38, 3813–3820; Schnur et al., "Ansamycin Derivatives as Antioncogene and Anticancer Agents," U.S. Pat. No. 5,932,655; all of which are incorporated herein by reference). Typical amines containing solubilizing functionalities include 2-(dimethylamino)-ethylamine, 4-aminopiperidine, 4-amino-1-methylpiperidine, 4-aminohexahydropyran, furfurylamine, tetrahydrofurfurylamine, 3-(aminomethyl)tetrahydrofuran, 2-(amino-methyl)pyrrolidine, 2-(aminomethyl)-1-methylpyrrolidine, 1-methylpiperazine, morpholine, 1-methyl-2(aminomethyl)aziridine, 1-(2-aminoethyl)-1-azabicyclo-[1.3.0]hexane, 1-(2-aminoethyl)piperazine, 4-(2-aminoethyl)morpholine, 1-(2-aminoethyl)pyrrolidine, 2-(2-aminoethyl)pyridine, 2-fluoroethylamine, 2,2-difluoroethylamine, and the like.

In addition to post synthesis chemical or biosynthetic modifications, various polyketide forms or compositions can be produced, including but not limited to mixtures of polyketides, enantiomers, diastereomers, geometrical isomers, polymorphic crystalline forms and solvates, and combinations and mixtures thereof can be produced Many other modifications of polyketides produced according to the invention will be apparent to those of skill, and can be accomplished using techniques of pharmaceutical chemistry.

Prior to use the PKS product (whether modified or not) can be formulated for storage, stability or administration. For example, the polyketide products can be formulated as a "pharmaceutically acceptable salt." Suitable pharmaceutically acceptable salts of compounds include acid addition salts which may, for example, be formed by mixing a solution of the compound with a solution of a pharmaceutically acceptable acid such as hydrochloric acid, hydrobromic acid, sulfuric acid, fumaric acid, maleic acid, succinic acid, benzoic acid, acetic acid, citric acid, tartaric acid, phosphoric acid, carbonic acid, or the like. Where the compounds carry one or more acidic moieties, pharmaceutically acceptable salts may be formed by treatment of a solution of the compound with a solution of a pharmaceutically acceptable base, such as lithium hydroxide, sodium hydroxide, potassium hydroxide, tetraalkylammonium hydroxide, lithium carbonate, sodium carbonate, potassium carbonate, ammonia, alkylamines, or the like.

Prior to administration to a mammal the PKS product will be formulated as a pharmaceutical composition according to methods well known in the art, e.g., combination with a pharmaceutically acceptable carrier. The term "pharmaceutically acceptable carrier" refers to a medium that is used to prepare a desired dosage form of a compound. A pharmaceutically acceptable carrier can include one or more solvents, diluents, or other liquid vehicles; dispersion or suspension aids; surface active agents; isotonic agents; thickening or emulsifying agents; preservatives; solid binders; lubricants; and the like. Remington's Pharmaceutical Sciences, Fifteenth Edition, E. W. Martin (Mack Publishing Co., Easton, Pa., 1975) and Handbook of Pharmaceutical Excipients, Third Edition, A. H. Kibbe ed. (American Pharmaceutical Assoc. 2000), disclose various carriers used in formulating pharmaceutical compositions and known techniques for the preparation thereof.

The composition may be administerted in any suitable form such as solid, semisolid, or liquid form. See Pharmaceutical Dosage Forms and Drug Delivery Systems, $5^{th}$ edition, Lippicott Williams & Wilkins (1991). In an embodiment, for illustration and not limitation, the polyketide is combined in admixture with an organic or inorganic carrier or excipient suitable for external, enteral, or parenteral application. The active ingredient may be compounded, for example, with the usual non-toxic, pharmaceutically acceptable carriers for tablets, pellets, capsules, suppositories, pessaries, solutions, emulsions, suspensions, and any other form suitable for use. The carriers that can be used include water, glucose, lactose, gum acacia, gelatin, mannitol, starch paste, magnesium trisilicate, talc, corn starch, keratin, colloidal silica, potato starch, urea, and other carriers suitable for use in manufacturing preparations, in solid, semi-solid, or liquified form. In addition, auxiliary stabilizing, thickening, and coloring agents and perfumes may be used.

In one aspect, the invention provides recombinant DNA molecules. In some embodiments, the invention provides a recombinant DNA molecule that contains an open reading frame of a polyketide synthase that includes an encoding sequence for a polyketide synthase domain, where the encoding sequence is SEQ ID NO:1–3, (or no:1' or 1") or a fraction thereof that encodes at least 10 consecutive amino acids of the polyketide synthase. In some embodiments, the invention provides a recombinant DNA molecule that comprises an encoding sequence for a geldanamycin synthase domain. In some of theses embodiments, the sequence is SEQ ID NO:1–3 (or no:1' or 1"). In some embodiments, the invention provides a recombinant DNA molecule encoding a geldanamycin PKS domain of at least 10 amino acids, where the DNA molecule includes a sequence contained in a sequence of SEQ ID NO:1–3 (or no:1' or 1").

In another aspect, the invention provides a recombinant expression system capable of producing a polyketide synthase domain in a host cell, where the system includes an encoding sequence for a geldanamycin polyketide synthase domain that is operably linked to control sequences effective in the host cell to produce RNA that is translated into the polyketide synthase domain. In a further aspect, the invention provides a host cell modified to contain the recombinant expression system.

In another aspect, the invention provides vectors. In some embodiments, the invention provides a vector containing geldanamycin PKS genes, where the vector is pKOS-256-144-1, pKOS-256-144-2, pKOS-256-144-3, pKOS-256-144-4, pKOS-256-154-1, pKOS-256-154-2, pKOS-256-154-3, pKOS-256-154-4, pKOS-256-154-5, pKOS-256-154-6, pKOS-256-154-7, pKOS-256-163-1, pKOS-256-163-2, pKOS-256-163-3, pKOS-256-107-1, pKOS-256-107-2, pKOS256-107-3, pKOS-256-107-4, pKOS-256-107-5, pKOS-256-107-6, or pKOS-256-107-7. In some embodiments, the invention provides a vector that includes an open reading frame of SEQ ID NO:1 (or no:1' or 1"). In some embodiments, the invention provides a vector that comprises an open reading frame of SEQ ID NO:3. In some embodiments, the invention provides a pKOS256-116-10 vector.

In yet another aspect, the invention provides an isolated and purified nucleic acid encoding a geldanamycin PKS domain, where the sequence of the nucleic acid is one of the follwing sequences: SEQ ID NO:4, SEQ ID NO:5, SEQ ID NO:6, SEQ ID NO:7, SEQ ID NO:8, SEQ ID NO:9, SEQ ID NO:10, or SEQ ID NO:11. In another aspect, the invention provides an isolated and purified geldanamycin LDD domain comprising the amino acid sequence of SEQ ID NO:12.

In another aspect, the invention provides a recombinant DNA molecule that comprises an open reading frame of a polyketide synthase, where the open reading frame includes an encoding sequence for a polyketide synthase domain, where the encoding sequence contains a sequence that is the sequence one of SEQ ID NO:1–3 and 22–38 (or no:1' or 1"), or a fraction thereof that encodes at least 10 consecutive amino acids of the polyketide synthase.

In another aspect, the invention provides recombinant DNA molecules. In some embodiments, the invention provides a recombinant DNA molecule that contains an encoding sequence for a herbimycin synthase domain. In some embodiments, the recombinant DNA molecule of contains a sequence of SEQ ID NO:1–3 and 22–38 (or no:1' or 1"). In some embodiments, the invention provides a recombinant DNA molecule encoding a herbimycin PKS domain that includes at least 10 amino acids, where the DNA molecule contains a sequence contained in a sequence from the following group of sequences: SEQ ID NO:1–3 and 22–38 (or no:1' or 1").

In a further aspect, the invention provides a recombinant expression system capable of producing a polyketide synthase domain in a host cell, where the system contains an encoding sequence for a herbimycin polyketide synthase domain, and where the encoding sequence is operably linked to control sequences effective in the host cell cell to produce RNA that is translated into the polyketide synthase domain. In another aspect, the invention provides a host cell modified to contain this recombinant expression system.

In a yet further aspect, the invention provides vectors. In some embodiments, the invention provides a, vector containing herbimycin PKS gene. In some embodiments, the invention provides a vector that contains an open reading frame of a herbimycin PKS clone, where the sequence of the open reading frame is one of SEQ ID NO:1–3 and 22–38 (or no:1' or 1"). In yet other embodiments, the invention provides a vector that contains an open reading frame of a herbimycin PKS cluster.

In another aspect, the invention provides an isolated and purified nucleic acid encoding a herbimycin PKS domain, where the sequence of the nucleic acid is from one of SEQ ID NO:1–3 and 22–38 (or no:1' or 1").

In a further aspect, the invention provides an isolated and purified herbimycin domain expressed from an isolated and purified nucleic acid whose sequence is from one of SEQ ID NO:1–3 and 22–38 (or no:1' or 1").

In one aspect, the invention provides recombinant DNA molecules, and vectors comprising those recombinant DNA molecules, that encode all or a portion of the geldanamycin PKS and that, when transformed into a host cell which is then cultured under conditions that lead to the expression of said geldanamycin PKS proteins, results in the production of geldanamycin and/or analogs or derivatives thereof in useful quantities. The present invention also provides recombinant host cells comprising those recombinant vectors. In a related aspect, the invention provides recombinant DNA molecules, and vectors comprising those recombinant DNA molecules, that encode all or a portion of the herbimycin PKS and that, when transformed into a host cell which is then cultured under conditions that lead to the expression of said herbimycin PKS proteins, results in the production of geldanamycin and/or analogs or derivatives thereof in useful quantities. The present invention also provides recombinant host cells comprising those recombinant vectors.

The invention provides the coding sequences for the proteins of the geldanamycin synthase complex, and DNA molecules in which the complete set of appropriately arranged geldanamycin PKS-encoding sequences are operably linked to expression control sequences that are effective in suitable host cells of the invention to produce geldanamycin and/or its analogs or derivatives. The invention similarly provides the coding sequences for the proteins of the herbimycin synthase complex, and DNA molecules in which the complete set of appropriately arranged herbimycin PKS-encoding sequences are operably linked to expression control sequences that are effective in suitable host cells of the invention to produce a herbimycin and/or its analogs or derivatives.

In a further aspect, the invention provides a method of identifying and isolating a PKS gene cluster from the genome of a host cell by: constructing a genomic library of the host cell into a vector, where the vector is a plasmid, cosmid, bacterial artificial chromosome, or yeast artificial chromosome; designing degenerate PCR primers homologous to a conserved region of the PKS gene cluster; performing PCR amplification using these degenerate primers and the host cell genome as template; cloning and sequencing the resulting PCR amplimers; comparing nucleotide sequences of the PCR amplimers to known homologs of the PKS gene cluster to create a sequence homology phylogenetic tree; analyzing the sequence homology data to deduce a most likely candidate PKS gene cluster; probing the host cell genomic library with the PCR amplimer as a probe; isolating genomic library clones that hybridize with the amplimer probe; and sequencing these positive genomic library clones.

EXAMPLES

Example 1

Identification of Nucleotide Sequences Encoding Domains of Geldanamycin Synthase from *Streptomyces hygrospcopicus* NRRL 3602

Genomic Library Generation and Screening. Genomic DNA of *Streptomyces hygroscopicus* 3602 was cloned into bacterial artificial chromosomes (BACs) to make a BAC library for screening. The particular BAC system was selected, because it allows genomic DNA fragments of up to approximately 50 Kb to be cloned into a single BAC, thus reducing the number of clones needed to encompass the *S. hygroscopicus* 3602 genome. Restriction fragment length analysis of the insert DNA in the BAC clones of the BAC library revealed that the average insert size was about 40–45 Kb (BAC clone DNA was prepared as described in Example 2). An array of 5,000 BAC clones from the BAC library was generated for screening on a high density nylon filter array (Amplicon, Pullman, Wash.).

Analysis of the *S. hygroscopicus* 3602 genome by PCR using degenerate primers to amplify KS domain encoding sequences showed that the genome contains about 65 different ketosynthase coding sequences. Thus, in screening the BAC library, there was a need for a two-prong approach to distinguish clones containing geldanamycin PKS gene cluster sequences from clones containing KS domain encoding sequences from other clusters. The BAC library was screened first with $^{32}$P-labeled Carbamoyl O-Transferase (CT) nucleic acid probes, and then, positive clones from the CT screen were screened with $^{32}$P-labeled Ketosynthase (KS) nucleic acid probes.

Carbamoyl Transferase Probe Screening. CT degenerate primer set 1 (SEQ ID NO:14 and SEQ ID NO:16) was used to PCR amplify *S. hygroscopicus* 3602 genomic DNA, and 20 amplimers were identified and sequenced. The sequence data revealed that all amplimers were identical. Specific CT primer pair (SEQ ID NO:17 and SEQ ID NO:18) was then used to generate an 849 bp CT probe (SEQ ID NO:13). This CT probe was used to identify BAC clones on the high density filter that hybridized specifically to the probe. Twenty one clones were identified and subjected to a second round of PCR with primer set 2 (SEQ ID NO: 14 and SEQ ID NO:15) to confirm that the clones contained the DNA; fifteen clones were positive by this test and used in the KS probe screen.

Ketosynthase Degenerate Primer PCR Screening. PCR with the KS degenerate primer pair (SEQ ID NO:19 and SEQ ID NO:20) was used to screen the CT-positive clones and to generate KS amplimers useful for sequencing and as probes. Nine of the fifteen clones contained sequences that amplified with the degenerate KS primers. Restriction mapping analysis of these clones and sequence analysis of the amplimers revealed that these clones contained coding sequences for no more than four different KS domains in addition to the CT sequences. Because the geldanamycin PKS was expected to contain at least seven different KS domains, this result suggested that the insert DNA of these nine clones did not span the entire geldanamycin biosynthetic gene cluster, and an effort to identify additional clones containing the missing portion of the gene cluster was undertaken.

Identification of Missing Portion of Geldanamycin PKS Gene Cluster and Probe Preparation. Because CT-positive BAC clones were isolated that did not contain KS domain coding sequences, it was expected that the CT sequences flanked the PKS encoding region. Restriction fragment length analysis revealed that the insert DNA of the nine clones containing both CT and KS coding sequences overlapped with the insert DNA of the clones that contained CT sequences but lacked KS sequences. Of the nine BAC clones containing both CT and KS coding sequences, the clone designated pKOS-256-107-3 had the longest insert (39 Kb), which was designated 5-CT.

Identification and Sequencing of BAC Clones Encompassing the Missing Portion of the Geldanamycin PKS Gene Cluster. Chromosome walking was performed to identify BAC clones having insert DNA overlapping the 5-CT insert and containing the missing portion of the geldanamycin PKS gene cluster. The KS PCR amplimers of the four different KS domain encoding sequences identified from the nine BAC clones that contained the CT and KS sequences were subcloned to obtain 4 different subclones: pKOS-256-144-1 through -4 (the KS domain coding sequences are shown in SEQ ID NO:4 through SEQ ID NO:7). These 4 amplimers were pooled and used as $^{32}$P radiolabeled KS probes in a hybridization at high stringency with the clones on the high density filter. Seven additional BAC clones, pKOS-256-154-1 through pKOS-256-154-7, were identified and found to contain three additional KS sequences.

Figure 4:
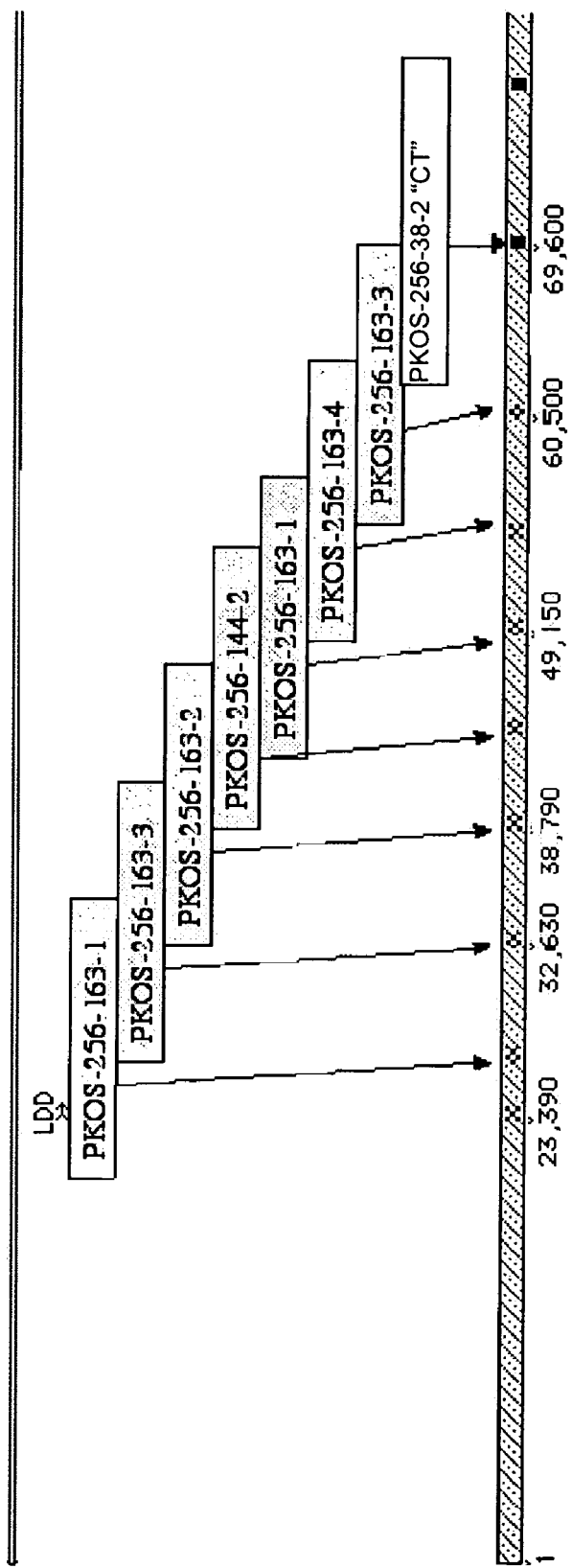
FIG. 4 is a schematic of the configuration of KS, CT, and LDD domains of geldanamycin PKS gene cluster and corresponding clones containing those domains.
Figure 8:
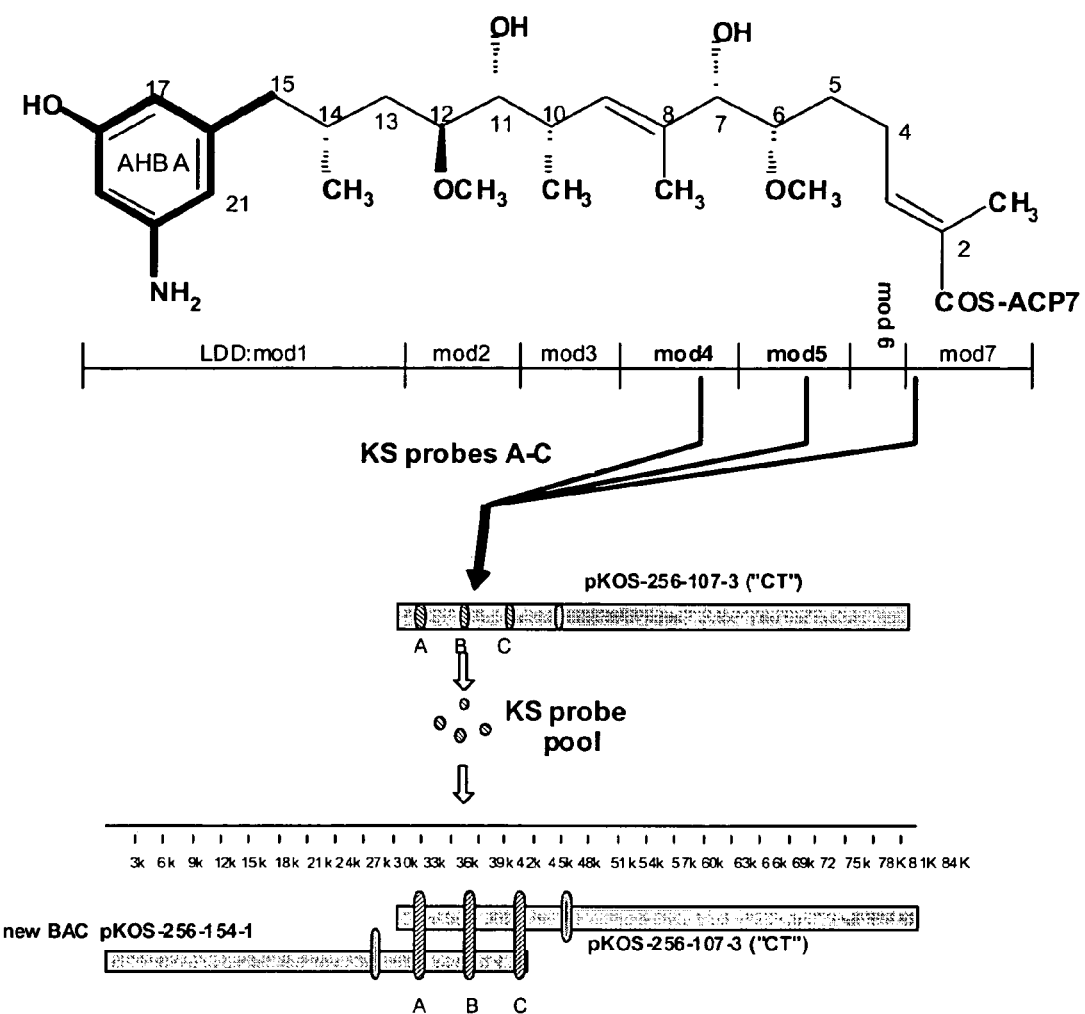
FIG. 8 is a schematic of the CT probe identified BAC showing overlap with KS probe hybridization sites of modules 4, 5 and 6.

One clone (pKOS-256-154-1) contained an insert, designated KS2, that overlapped with the 5-CT insert and contained all three of the additional KS domain coding sequences; the insert of this clone is shown on FIG. 3. Based on the structure of progeldanamyin (See FIG. 2), the geldanamycin PKS gene cluster was expected to have 7 modules. Thus, the geldanamycin PKS gene cluster and additional genes of the geldanamycin biosynthetic gene cluster can be assembled from BAC clones pKOS256-107-3 and pKOS256-154-1. The seven KS domain coding sequences of the geldanamycin PKS genes are shown in SEQ ID NO:4 through SEQ ID NO:10; these sequences were subcloned into vectors pKOS-256-144-1, pKOS-256-144-2, pKOS-256-144-3, pKOS-256-144-4, pKOS-256-163-1, pKOS-256-163-2, and pKOS-256-163-3. The KS domain coding sequences, corresponding vectors, and organization of the geldanamycin PKS gene cluster is shown in FIG. 4 and FIG. 8. The overlap of BAC clones pKOS256-107-3 and pKOS256-154-1 at the KS probe hybridization sites and overlap of the deduced geldanamycin PKS gene cluster organization is shown in FIG. 3A and FIG. 8.

The geldanamycin PKS gene cluster contig nucleotide sequence is provided in SEQ ID NO:1 below. Standard IUPAC ambiguity codes are used in the sequence. The insert of BAC clone pKOS256-154-1 ("KS2") corresponds to bases 1–44591 of SEQ ID NO:1. This subsequence of SEQ ID NO:1 is sometimes referred to herein as Sequence ID NO:1'. The insert of clone pKOS256-107-3 ("CT") corresponds to bases 30398–85692 of SEQ ID NO:1. This subsequence of SEQ ID NO:1 is sometimes referred to herein as Sequence ID NO:1'''. References herein to SEQ ID NO:1 or fragments thereof (e.g., fragments of at least 100 bp) or protein coding regions thereof are also intended to refer to Sequence ID NO:1' and Sequence ID NO:1''. Translations of selected ORFs in SEQ ID NO:1 are provided as SEQ ID NOS:115–146.

TABLE 1, above, provides open reading frame (ORF) boundaries corresponding to the nucleotide position in SEQ ID NO:1 of the geldanamycin PKS as well as the nucleotide sequences encoding enzymes involved in precursor synthesis and progeldanamycin modification.

Figure 7:
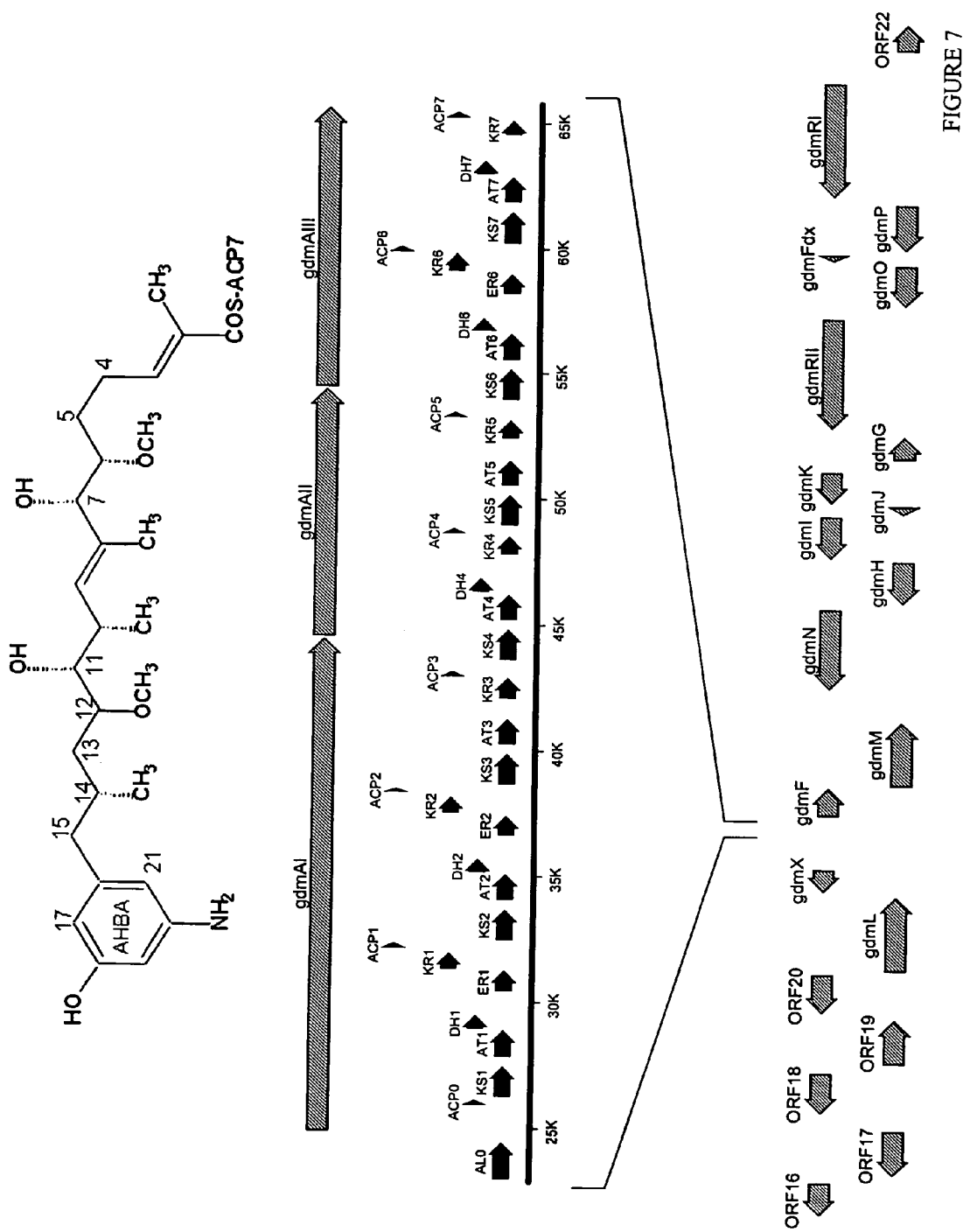
FIG. 7 is a schematic of the geldanamycin PKS gene cluster showing ORFs and modifying genes. Abbreviations: ORF 16: efflux (SC3C8.01); gdmL: oxred. (rif19); gdmF: amide synthase (riff); ORF 17: secreted protein (SC3C8.01); gdmX: unknown (homolog of JadX MmyY); gdmM: flavin-dependent monooxygenase (rif19); ORF 18: hydrolase (SCF1.09); gdmA1: PKS modules 0–3; gdmN: carbamoyltransferase; ORF 19: transcriptional regulation (AraC family); gdmA2: PKS modules 4–5; gdmH: methoxymalonyl-ACP biosynthesis; ORF 20: transcriptional regulation (tetR); gdmA3: PKS modules 6–7; gdmI: Methoxymalonyl-ACP biosynthesis; gdmJ: Methoxymalonyl-ACP biosynthesis; gdmFdx: ferredoxin; gdmP: P450; gdmK: Methoxymalonyl-ACP biosynthesis; gdmRI: transcriptional regulation; gdmG: Methoxymalonyl-ACP biosynthesis; ORF 22: hydrolase ns; gdmRII: transcriptional regulation; gdmO: aminoDHQ synthase; (ahba3) gdmP: Regulation 450.

In addition to the ORFs listed in TABLE 1 above, SEQ ID NO:1 includes additional open reading frames of genes encoding proteins that may be useful in the biosynthesis of progeldanamycin, geldanamycin, and geldanamycin analogs in certain host cells and/or have other uses. These include, for example and not limitation, the following ORFs (nucleotide boundaries): ORF10 (10864-11565), ORF11 (11987-12367), ORF12 (13068-13829), ORF13 (13909-14655), ORF14 (14564-15013), and ORF15 (15122-15700). FIG. 7 shows the Geldanamycin PKS gene cluster and upstream and downstream modifying genes and ORFs.

The geldanamycin biosynthetic gene cluster is believed to include all of the genes from ORF 19 on the left flanking region (thus, ORFs 12 through 18 are outside the cluster) through and beyond ORF22 (less than about five genes of the cluster are believed to extend beyond ORF22).

Example 2

BAC DNA Preparation

A 10 mL culture was inoculated with a single colony from the filter and grown at 37° C. overnight in LB medium with chloramphenicol selection (12.5 µg/mL). The cells were pelleted by centrifugation and resuspended in 300 µl of TE buffer (50 mM tris pH8/10 mM EDTA) and 300 µl of lysis solution (0.2 N NaOH/1% SDS) and mixed gently. The lysis solution was then neutralized with 300 µl of 3 M KOAc for precipitation and put on ice for 5 minutes. Following precipitation, a phenol extraction was done followed by an isopropanol precipitation. The DNA was centrifuged and resuspended in 250 µl of TE buffer ($OD_{260}$~10 µg/µl). RNAse digestion (Sigma Chemical Co., St. Louis, Mo.) was performed by adding RNAse to a concentration of 200 µg/ml and incubating at 37° C. for 30 min. DNAse digestion (Epicentre Technologies, Madison, Wis.) was done to eliminate non-plasmid DNA by incubation at 37° C. overnight. The DNAse was inactivated by heat incubation at 75° C. for 20 minutes. An isopropanol precipitation was performed by adding isopropanol and 3 M NaOAc to the sample and placed on ice for 10 minutes. The DNA was centrifuged at 4500 RPM for 45 minutes at room temperature. The DNA pellet was redissolved in TE buffer. The usual yield was about 50–100 µg/mL.

Example 3

Identification of Nucleotide Sequences Encoding Domains of Herbimycin Synthase from *Streptomyces hygrospcopicus* AM-3672

Genomic Library Generation and Screening. Genomic DNA of *Streptomyces hygroscopicus* AM-3672 was cloned into a pSET152 based plasmid-pKOS97-64c (see FIG. 10) as a vector. For library preparation, pKOS279-64C was cut with BglII and the genomic DNA was partially digested with Sau3AI to obtain DNA fragments about 38–43 kb. This ligation mixture of linearized DNA was packaged into cosmids with Gigapack® III XL Packaging Extract (Stratagene, Inc., LaJolla, Calif.) and then transfected into XL1-blue *E. coli* strain. A library of 2304 colonies was obtained and analyzed. The transfectants were grown on LB agar having apramycin at a final concentration of 60 mg/L. The transfectants were spread onto nylon-membranes to allow the cells to grow into the membrane structure. After alkaline cell wall disruption, the DNA was bound to the membrane by UV cross linking under standard conditions. These colony-blot membranes were then used to screen the library.

Genomic *Streptomyces hygroscopicus* AM-3672 cosmid library screening. Because the product of the PKS is usually modified by several tailoring steps in the biosynthetic pathways for the majority of bacterial polyketides, homologs of genes that are likely to be unique to the pathway of interest or to a particular class of compounds are targeted as probes for the desired PKS cluster. In the case of herbimycin, a geldanamycin homolog, the genes for formation of the C7 carbamoylation (CT) and also the CoA-ligase that activates the AHBA (3-Amino-5-hydroxybenzoic acid) starter unit to be loaded on the first PKS module were used as the target genes for probe generation. Analysis of the *S. hygroscopicus* AM-3672 genome by PCR was performed using those two different sets of degenerate primers: one aimed at amplifying regions with homology to domains of the CoA-ligase-type from PKS sources ($AL_O$ Domain Probe); the other aimed at amplifying regions with homology to carbamoyltransferase (CT Probe). This two-prong approach was needed to distinguish clones containing herbimycin PKS gene cluster sequences from clones containing KS domain encoding sequences from other clusters.

Carbamoyl transferase gene fragments were amplified with degenerate forward primer degCT2F (5'-AARGT-SATGGGSYTSGCSCCSTA-3') (SEQ ID NO:41) and reverse primers degCT3R (5' CCSARSGCSCKSGGSC-CRAAYTC-3') (SEQ ID NO:44) using an annealing temperature of 55° C. This PCR reaction produces amplimers of 650 bp in length when using the *Streptomyces hygroscopicus* AM-3672 genome as a template. CoA-ligase gene fragments were amplified with degenerate forward primer LDDF1 (5'-GAY GAS CCS GCS TGG ATG YTS TA-3') (SEQ ID NO:43) and reverse primers LDDB2 (540 -CCR TCS GTS CKG TAC CAS CCR TC-3') (SEQ ID NO:44) using an annealing temperature of 64° C. This PCR reaction produces amplimers of 690 bp when using the *Streptomyces hygroscopicus* AM-3672 genome as a template. All PCR amplimers were gel-purified and cloned into pCR2.1-TOPO using TA cloning (Invitrogen). Two clones of each construct (CT and CoA-ligase) have been sequenced and analysed with Sequencher 4.1 (Gene Codes Corporation) and MacVector 6.5.3 software, and compared with sequences in the public databases using the CLUSTAL W and BLAST programs. CoA-ligase and CT amplimer sequences on DNA level were 97% identical with the corresponding sequences of the Geldanamycin producer *S. hygroscopicus* strain 3602, whereas the direct comparison between the two sequences of each gene turned out to give an identity of 98.5%. Given this degree of homology, both CoA-ligase sequences and also both CT sequences compared were considered to be identical and any differences probably caused by PCR errors. Therefore the analysis revealed one putative CoA-ligase (pKOS313-60-1) and one putative CT gene fragment (pKOS313-60-2) with very high homology of 97% to the Geldanamycin gene cluster. Both inserts of (pKOS313-60-1) and (pKOS313-60-2) have been used as probes to screen the genomic cosmid library for the herbinycin PKS and related genes. Analysis at this stage was done at the DNA level, only. Possible errors at the protein level have yet to be determined.

CoA-ligase ($AL_O$) Probe Screening. CoA-ligase gene fragments were amplified with degenerate forward primer LDDF1 (5'-GAY GAS CCS GCS TGG ATG YTS TA-3') (SEQ ID NO:43) and reverse primers LDDB2 (5'-CCR TCS GTS CKG TAC CAS CCR TC-3') (SEQ ID NO:44) using an annealing temperature of 64° C. This PCR reaction produces the $AL_O$ probe having 690 bp in length. Two separate clones (pKOS313-60-1 and pKOS313-60-2) were sequenced and analysed with Sequencher 4.1 (Gene Codes Corporation) and MacVector 6.5.3 (Accelrys), Each PCR insert (after removing sequence due to primers) was 644 bp (SEQ ID. NO: 22 and SEQ ID NO: 23). Each was closely homologous (96%) to a 645 bp portion of the AL-ligase-homology domain region of the geldanamycin cluster. Each had a single deletion (at different locations) relative to the geldanamycin sequence. In each case where the two sequences varied, one matched the geldanamycin sequence. If a hypothetical sequence is created, using the common sequence where they match, and the one matching the geldanamycin sequence otherwise, then the insert of pKOS313-60-1 is 98.6% identical to this construct; pKOS313-60-5 is 98.3% identical; and the equivalent 945 bp portion of the geldanamycin cluster is 97.2% identical.

Carbamoyl Transferase (CT) Probe Screen. Carbamoyl transferase gene fragments were amplified with degenerate forward primer degCT2F (5'-AARGTSATGGGSYTSGC-SCCSTA-3') (SEQ ID NO:41) and reverse primers degCT3R (5' CCSARSGCSCKSGGSCCRAAYTC-3') (SEQ ID NO:42) using an annealing temperature of 55° C. This PCR reaction produces a CT probe of 650 bp in length. Two separate clones (pKOS313-60-3 and pKOS313-60-4) were sequenced and analysed. Each PCR insert (after removing sequence due to primers) was 599 bp (see SEQ ID NO:24 and SEQ ID NO:25). Each was closely homologous (96% identity) to a 600 bp portion of the AL-ligase-homology domain region of the geldanamycin cluster. Each had a single deletion (at different locations) relative to the geldanamycin sequence. If a hypothetical sequence is created as in the previous case (here there is one base-pair where all three vary), then the two inserts are each about 99% identical to this construct; and the equivalent 945 bp portion of the geldanamycin cluster is about 97% identical.

The inserts of pKOS313-60-1($AL_0$ probe) and pKOS313-60-4 (CT probe) were used to screen the genomic cosmid library for the herbimycin PKS and related genes (the two inserts were combined during screening, so that cosmids matching either would score as positive). Using the insert fragments of pKOS313-60-1 and pKOS313-60-4, the probes were prepared using colorimetric DIG-labelling reaction following the DIG nucleic acid detection Kit (Roche) The in-situ hybridization was done under standard conditions, hybridization temperature 65° C. following the DIG easy Hyb (Roche) protocol. Thirty six positive colonies were found, subjected to fragment analysis, and grouped by banding patterns. Seven cosmids representing two groups (pKOS279-78-14, -4, -11 from one group; pKOS279-78-17, -5, -19 from the other; as well as pKOS279-78-16 which appeared to be a possible member of the first group) were chosen for further analysis, in which BamHI fragments were end-sequenced. Seven independent fragments produced 13 legible end sequences, all closely homologous to regions of the geldanamycin cluster.

The seven legible end-sequenced regions of the four fragments from group one (see SEQ ID NO:26-SEQ ID NO:32) were all homologous to portions of the upstream portion of the geldanamycin cluster, with the most downstream sequence matching a portion of the CoA-ligase homology region near the upstream edge of the PKS genes and the most upstream match being over 20 kb away from the PKS genes. All seven regions appeared in fragments from pKOS279-78-4. All homologies found were in the range of 93%–96% DNA sequence identity. All were compatible with equivalent arrangements of genes between the geldanamycin and herbimycin clusters. The downstream edge of fragment4.group1 produced 405 bp of clear sequence with 96% identity to 405 bp within the 645 bp of the geldanamycin cluster homologous to the CoA-ligase-homolog probe; the 405 bp exactly matches the equivalent 405 bp from the theoretically constructed sequence described above (i.e., it matches both probe sequences when they are identical; if they differ, then it matches both the geldanamycin cluster and one of the two probes). Clone pKOS279-78-4 contains all or the bulk of the accessory genes on the upstream side of the cluster, extending into at least the initial polydomain PKS gene. The cosmids of group 1 were all recognized by the "CoA-ligase" probe.

The six legible end-sequenced regions of the three fragments from group two (see SEQ ID NO:33-SEQ ID NO:38) were all homologous to portions of the downstream portion of the geldanamycin cluster, with the most upstream sequence (from fragment1.group2) matching a portion of the module 7 region, the terminal module of the PKS genes, and the most downstream matching a region over 20 kb from the PKS genes. All three fragments appear to be present in pKOS279-78-17. It seems probable that pKOS279-78-17 contains all or the bulk of the accessory genes on the downstream side of the cluster, extending from at least the terminal polydomain PKS module region, and that the cosmids of group 2 were all recognized by the "CT" probe.

The herbimycin PKS gene cluster nucleotide sequence fragments are listed in SEQ ID NOS:22–38 below. [ASEQ ID NO:22 (insert of pkos313-60–1; CoA-ligase homology); SEQ ID NO:23 (Insert of pKOS313-60-2; CoA-ligase homology); SEQ ID NO:24 (Insert of pKOS313-60-3; carbamoyltransferase homology); SEQ ID NO:25(Insert of pKOS313–60–4; carbamoyltransferase homology); SEQ ID NO:26 (Group 1, fragment 1a.Contig[4R/16J__20.L]); SEQ ID NO:27 (Group 1, fragment 1b.Contig[4R/16J__48.Rrev]); SEQ ID NO:28 (Group 1, fragment 2a.Contig [4T/U.L]); SEQ ID NO:29.(Group 1, fragment 3a.Contig [4V/14Q.L]); SEQ ID NO:30 (Group 1, fragment 3b.Contig [4V/14Q.Rrevc]); SEQ ID NO:31 (Group 1, fragment 4a.Contig[4U/11W/14P.L]); SEQ ID NO:32 (Group 1, fragment 4b.Contig[4U/11W/14P.Rrevc]); SEQ ID NO:33 (Group 2, fragment 1a.Contig[5F/19FI.L]); SEQ ID NO:34 (Group 2, fragment 1b.Contig[5F/19FI/17D.Rrevc]); SEQ ID NO:35 (Group 2, fragment 2a.Contig[5E/17C.L]); SEQ ID NO:36 (Group 2, fragment 2b.Contig[5E/17C.Rrevc]); SEQ ID NO:37 (Group 2, fragment 3a.17A-72-48.dna); SEQ ID NO:38 (Group 2, fragment 3b.17A-72-20.dna.revc).] Standard IUPAC ambiguity codes are used in the sequence.

The inserts of clones pKOS279-78-14 and pKOS279-78-4 were sequenced at Macrogen (Korea). To identify PKS genes that would connect the two cosmids, a new genomic DNA library was built. Sau3AI -partial-digested genomic DNA of Str. hygroscopicus AM3672 was cloned in the SuperKos plasmid to generate the new cosmid library. About 2000 colonies carrying cosmids were screened by in-situ hybridization against parts of gdmKS4 and gdmDH7, which were cloned in pKOS279-46A. [KOS279-46A was composed of two fragments from the gdm PKS cluster cloned into the EcoRI-HindIII sites of pKC1139 (Bierman et al., 1992, Gene 116:43–49). The left fragment consisted of a 1.3 kb region upstream of AT4 amplified with the following primers: forward, 5'-TTGAATTCAGATCTAGTTCGCTG-GAGGACAGCGACGTC [SEQ ID NO:45]; reverse, 5'-TTTCTAGAGGATCCGCCGTCTGTTCC GGTCT-GTCCGGTG [SEQ ID NO:46]. The right fragment consisted of a 1.3 kb region downstream of AT7 amplified with the following primers: forward, 5'-TTTCTAGACTG-CAGCGCGGCGGTCCGGGCG ACGTCCGT [SEQ ID NO:47]; reverse, 5'-TTAAGCTTATGCATCGGGTC GTGACCTCGGCGGTGTC [SEQ ID NO:48]. Using this method, about a dozen cosmids were identified and ends of inserts in these cosmids were sequenced.

Two cosmids containing interesting sequences were chosen for further analysis. One of them, pKOS205-110-12, carrying sequences overlapping with the insert of pKOS279-78-17 was sequenced at Macrogen (Korea). Anther one, pKOS205-110.29, overlapping pKOS278-78-4 and pKOS205-110-12 was used as the template for sequencing by oligo walking combined with PCR to complete the approximately 2 kb gap between pKOS279-78.4 and pKOS205-110.12.

The sequence of the herbimycin PKS gene cluster and flanking genes is provided below (SEQ ID NO:2). In addition to the ORFs listed in TABLE 1 above, SEQ ID NO:2 includes additional open reading frames of genes encoding proteins that may be useful in the biosynthesis of progeldanamycin, herbimycin, and herbimycin analogs in certain host cells and/or have other uses. These include, for example and not limitation, the following ORFs (nucleotide boundaries): ORF11_hbm (complement of 12619-12999); ORF14_hbm (16346-17641) a putative permease; and ORF15_hbm (17750-18328). FIG. 3B shows the Herbimycin PKS gene cluster and upstream and downstream modifying genes and ORFs. Translations of selected ORFs in SEQ ID NO:2 are provided as SEQ ID NOS:85–114.

producer of herbimycin, *S. hygroscopicus* 3672, a closely related molecular analog of geldanamycin, 20 AHBA amplimers were analyzed and all of them were identified to be 100% identical with AHBA-B from the geldanamycin producer. Only one type of AHBA synthase was found in the producer of herbimycin, *S. hygroscopicus* 3672.

TABLE 2

AHBA Biosynthesis Pathway Homologs in the Gdm and AHBA Clusters of *S. hygroscopicus* NRRL 3602 (SEQ ID NO: 3)

| AHBA biosynthesis pathway code | homology family | predicted function | ahba cluster (*S. hygroscopicus* NRRL 3026) | length (aa) | homolog | % identity |
|---|---|---|---|---|---|---|
| AHBA gene cluster | | | | | | |
| ahba1a | oxidoreductase | oxidoreductase homolog involved in aDAHP precursor biosynthesis | ORF6 | 360 | AnsG | 64%/360 aa |
| ahba1b | phosphatase | phosphatase homolog involved in aDAHP precursor biosynthesis | ORF7 | 231 | AnsH | 73%/225 aa |
| ahba1c | kinase | kinase homolog involved in aDAHP precursor biosynthesis | ORF3c | 265 | Asm22 | 63%/232 aa |
| ahba3(#2) | aDHQ synthase | aminodehydroguinate synthase | ORF2 | 349 | MitP | 74%/335 aa |
| ahba4 | aDHQ dehydratase | aminodehydroquinate dehydratase | ORF4c | 149 | Asm23 | 75%/139 aa |
| ahba5 | AHBA synthase | 3-amino-5-hydroxybenzoic acid synthase | ORF5 | 388 | AnsF | 79%/387 aa |
| Geldanamycin PKS gene cluster | | | | | | |
| ahba3(#1) | aDHQ synthase | aminodehydroquinate synthase | GdmO | 354 | Asm47 | 78%/340 aa |

Example 4

AHBA Biosynthesis Gene Cluster Identification and Isolation

Figure 5:
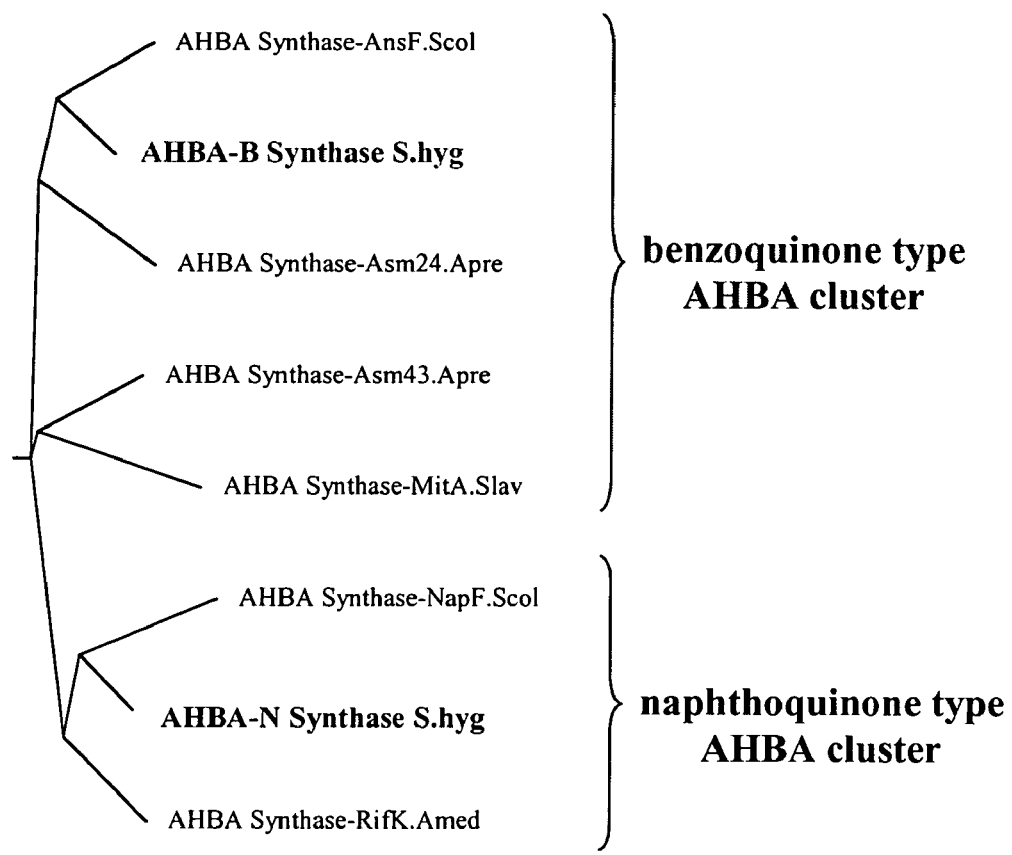
FIG. 5 is a phylogenetic tree showing the two groups of DNA sequences encoding AHBA-B type and AHBA-N type AHBA synthases.

Four homologs of the genes for AHBA biosynthesis were chosen to design a new set of PCR primers to screen the *S. hygroscopicus* NRRL 3602 genomic DNA for AHBA synthase and homologs (Yu et al., 2002, *Proc Natl Acad Sci USA*. 99:7968–73; August et al., 1998, *Chem Biol* 5:69–79; Leistner, 1999, *Eur J Biochem* 261, 98–107). Fifty-six AHBA amplimers were analyzed and their sequences compared resulting in two distinct DNA sequences encoding AHBA synthases being identified as AHBA-B and AHBA-N. FIG. 5 shows a phylogenetic tree of the two groups of AHBA-B and AHBA-N sequences having 75% homology. TABLE 2 below shows the homology data of AHBA cluster genes that strongly suggests that one AHBA synthase homolog belonged to the family associated with the biosynthesis of benzoquinone ansamycins (AHBA-B) and the other with naphthaquinone ansamycins (AHBA-N). Geldanamycin being a benzoquinone ansamycin, it was concluded that most likely the product of AHBA-B and not AHBA-N is involved in the biosynthesis of geldanamycin. Using the same PCR analysis method on the genomic DNA of the The AHBA-B synthase amplimer of 850 bp. was used as probe for screening of a genomic library made in a single copy BAC vector by The Institute for Genome Research (TIGR). 4,896 BACs with average insert sizes of 45 kb, equivalent to ca. 20× coverage of this genome, were screened and 36 AHBA synthase clones were identified. Given the gene coverage of this library, these numbers are consistent with the presence of the two AHBA synthase genes identified by PCR in this genome. AHBA-B and AHBA-N synthase containing BACs were distinguished by performing PCR with gene specific primers and it was found that about half of the AHBA synthase containing BACs belonged to each of the AHBA-B and AHBA-N types. Interestingly, when the AHBA synthase BACs were analyzed for the presence of PKS genes by performing PCR with degenerate KS primers, it was found that none of the 20 AHBA-B synthase containing BACs contained PKS genes, whereas 14 out of 17 AHBA-N synthase containing BACs also had PKS genes. As none of the putative geldanamycin AHBA-B synthase BACs apparently contained any KS genes, AHBA-B BAC clone pKOS-256-116-10 was fully sequenced by the shotgun method at TIGR and the resident genes of an 8 kb part of the pKOS-256-116-10 insert (approx. 50 kb total) was assigned to AHBA production on the basis of data base comparisons (FIG. 5). Six open reading frames (ORF) and the deduced functions of their products are listed in TABLE 2 as well as their homology to related genes. The ORFs corresponding to these genes are found in SEQ ID NO:3 as follows: ahba1a (basepairs 5263–6345); ahba1b (basepairs 6575–7270); ahba1c (basepairs 2427–3224 (complement); ahba3 (basepairs 1364–2413); ahba4 (basepairs 3397–3846 (complement); ahba5 (basepairs 4058–5224) and orf1 (possible regulatory protein) (basepairs 428–1252 (complement)). Translations of selected ORFs in SEQ ID NO:3 are provided as SEQ ID NOS:21, 39–40, and 147–153.

Key features of the AHBA biosynthesis genes and their deduced products. Based on the proposed AHBA biosynthetic pathway (August et al., 1998, "Biosynthesis of the ansamycin antibiotic rifamycin: deductions from the molecular analysis of the rif biosynthetic gene cluster of *Amycolatopsis mediterranei* S699." *Chem Biol* 5:69–79) the six ORFs were assigned to their deduced products and the functions found to be largely consistent with the postulated AHBA pathway. With reference to FIG. 1 of the August et al. publication, the assignments were: E4P→aminoDAHP (ahba2); aminoDAHP→aminoDHQ (ahba3); aminoDHQ→aminoDHS (ahba4); aminoDHA→AHBA (ahba5). However no aminoDAHP gene was found in or near the AHBA cluster. Nor has one yet been found near the geldanamycin PKS cluster, while interestingly one pathway homolog, the aminodehydroquinate synthase gene, was found in both clusters. It was found that the genes for AHBA biosynthesis are not closely located to GdmO, the ahba3 homolog located downstream of the geldanamycin PKS gene, but instead are located more than 30 kilobases from the end of the BAC that contains GdmO. A similar situation holds true for the reported ansamitocin cluster (Yu et al.) and a distantly linked ahba cluster in the ansamitocin producer: here, three of the AHBA biosynthesis genes for ansamitocin production plus the remaining asm genes have recently been reported to be on a subcluster separated from all the other genes for AHBA biosynthesis by at least 30 kb. In this case also no ahba2-family homolog is present in either cluster, while a different pathway homolog, the ahba5 gene is found in both clusters.

Bacterial Strains and Culture Conditions. The geldanamycin producing strain, first described by DeBoer et al. (DeBoer et al., 1970, *J Antibiot (Tokyo)* 23:442–7; Leistner et al., 1999, *Eur J Biochem* 261:98–107) as *Streptomyces hygroscopicus* var. *geldanus* var. nova UC-5208, was obtained from the Northern Regional Research Laboratory of the Agricultural Research Service as *Streptomyces hygroscopicus* NRRL 3602. To confirm production of geldanamycin, spores from a single colony, stored as a suspension in 25% (v/v) glycerol at −80° C., were used to inoculate 5 ml of R2YE liquid media. The culture was incubated at 28° C. for 36 h, transferred into 100 ml geldanamycin production medium and the final culture incubated at 28° C. for another 5 days. Following low speed centrifugation, the cell pellet from the culture was extracted with methanol by stirring for 10 min. The methanol broth was clarified by centrifugation (17,500×g) and the supernatant was analyzed for the presence of geldanamycin using HPLC under the following conditions: column Inertsil C18 (4.6×150 mm, Ansys Technologies, Inc.), mobile phase 60% acetonitrile (isocratic), flow rate (2 ml/min), temperature (40° C.), detection (UV 315 nm), injection volume (10–20 microliters). Geldanamycin (Sigma-Aldrich) was quantified by comparing the peak area at 315 nm with that measured for a standard solution. The standard solution was prepared by dissolving pure geldanamycin at 0.2–0.5 mg/mL in HPLC-grade methanol. The titer of geldanamycin was approx. 250 mg/L.

Manipulation of DNA and organisms. For genomic DNA extraction, a spore stock was used to prepare a seed culture as described above. The entire seed culture was transferred into 50 ml of the same growth medium in a 250 ml baffled Erlenmeyer flask and incubated for 48 h at 28° C. A 20 ml portion of the cell suspension was centrifuged (10,000×g) and the resulting pellet was washed with 10 ml buffer 1 (Tris, 50 mM, pH7.5; 20 mM EDTA). The pellet was pulverized with mortar and pestle under liquid nitrogen and transferred into 3.5 ml of buffer containing 150 µg/ml RNase (Sigma-Aldrich). After incubation of the mixture at 30° C. for 20 min, the salt concentration was adjusted by adding 850 µl 5 M NaCl solution, then the mixture was extracted multiple times with phenol:chloroform:isoamylaclohol (25:24:1, vol/vol) with gentle agitation followed by centrifugation for 10 min at 3,500×g. After precipitation with 1 vol of isopropanol, the genomic DNA knot was spooled on a glass rod and redissolved in water (200 µl). This method yielded about 1 mg DNA with a protein factor of about 2, as determined by the ratio of the UV absorbances at 260 and 280 nm. Standard agarose gel electrophoresis using 0.7% Seakem® LE-Agarose (BioWhitaker Molecular Applications, Rockland, Me.) at a voltage of 50 mV over night revealed that the sample contained mainly high molecular weight DNA fragments of about 60 kb.

Genomic analysis of *S. hygroscopicus* NRRL 3602 for AHBA gene cluster. The following degenerate AHBA synthase primers were used to scan the genomic DNA of *S. hygroscopicus* for AHBA genes:

```
degAH-F1
(5'-GTSATCGTSCCSGCSTTCACSTTC-3')      [SEQ ID NO:49]

degAH-F2
(5'-ATC-ATGCCSGTSCAYATGGCSGG-3') and [SEQ ID NO:50]
two reverse primers degAH-R1
(5'-GGSTBS-GKGAACATSGCCATGTA-3')      [SEQ ID NO:51]

degAH-R2
(5'-CKRTGRTGSARCCASTKRCARTC-3')       [SEQ ID NO:52]
```

Forward (F) and reverse (R) primers were tested in all possible combinations in standard PCR reactions with annealing temperatures between 50 and 60° C. The primers were also successfully used on genomic DNA of several other ansamycin producing strains at Tm 50° C. A typical 50 µl PCR reaction consisted of 200 ng genomic DNA, 200 pmol of each primer, 0.2 mM dNTP (containing 7-deaza-dGTP), 10% DMSO and 2.5 U Taq DNA polymerase (Roche Applied Science). Deg. PKS-KS primers were used to scan AHBA positive BAC clones (hybridization) for PKS genes (see also FIG. 3):

```
degKS1F
(5'-TTCGAYSCSGVSTTCTTCGSAT-3')        [SEQ ID NO:53]

degKS2F
(5'-GCSATGGAYCCSCARCARCGSVT-3'),      [SEQ ID NO:54]

degKS3F
(5'-SSCTSGTSGCSMTSCAYCWSGC-3'),       [SEQ ID NO:55]

degKS5R
(5'-GTSCCSGTSCCR-TGSSCYTCSAC-3'),     [SEQ ID NO:56]

degKS6R
(5'-TGSGYRTGSCCSAKGTTSSWCTT-3') and   [SEQ ID NO:57]

degKS7R
(5'-ASRTGSGCRTTSGTSCCSSWSA-3').       [SEQ ID NO:58]

A set of four gene specific primers:
AH-B-spF
(5'-AGGACAGTGGCGCGGCAAGAA-3'),        [SEQ ID NO:59]
```

-continued

AH-B-spR
(5'- GGTCGACGATCTT-CGCGCGGCG-3')    [SEQ ID NO:60]

AH-N-spF
(-5'-TCGACGTGGCTGCCGCGG-CTT-3'), and [SEQ ID NO:61]

Figure 6:
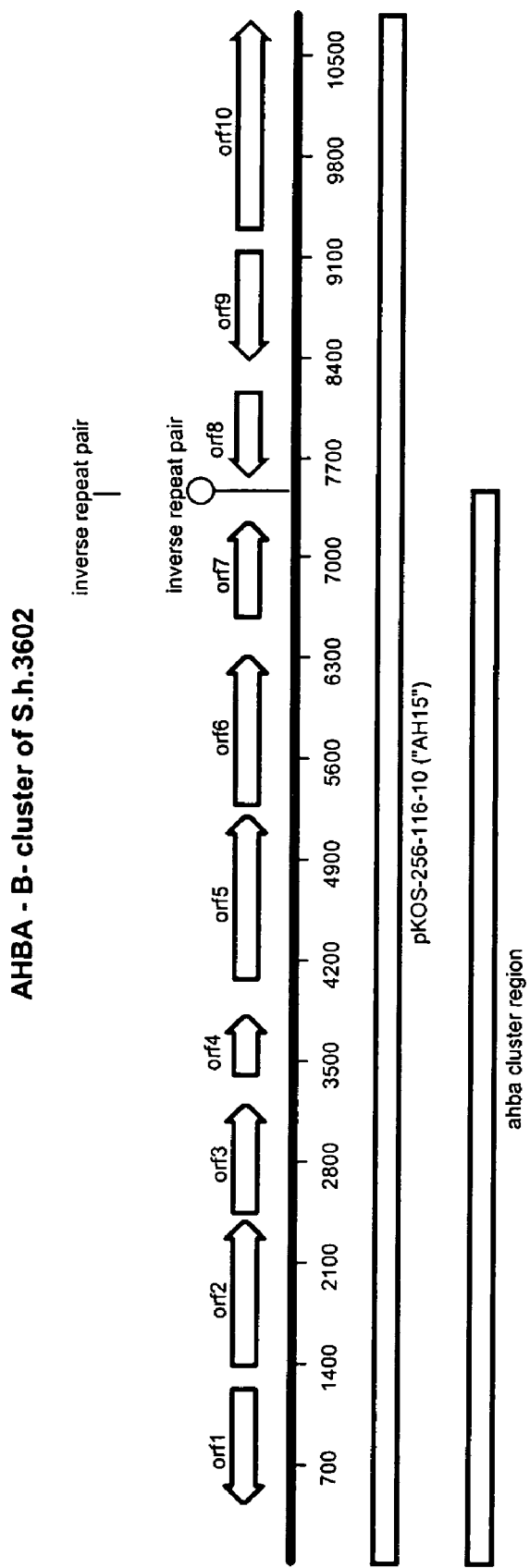
FIG. 6 is a schematic of pKOS-256-116-10 ("AH15") showing the open reading frames and other structural motifs of the AHBA-B gene cluster of *Streptomyces hygroscopicus* NRRL3602.

AH-N-spR (5'-TGTCGA-CGAGGGCGTTGCGGG-3') were used to distinguish between AHBA-B and AHBA-N synthase genes (FIG. 6). PCR amplimers were gel-purified and cloned into pCR2.1-TOPO using TA cloning (Invitrogen). For each primer pair, a representative set of cloned amplimers (600–800 bp) was sequenced using a Beckmann CEQ2000 with M13 forward and reverse primers.

Library construction and gene isolation. A genomic library of *S. hygroscopicus* NRRL3602 was constructed using the proprietary single copy BAC vector pHOS3 (TIGR). A total of 4,896 BAC clones were arrayed into 384 well microtiter plates and were spotted in high density onto nylon filters (Amplicon Express). A set of identical filters was created in order to probe the library simultaneously with different probes. Probes were labeled using $\alpha$-$^{32}$P-dCTP and a random prime labeling system (rediprime II, Amersham Pharmacia Biotech). Filters were hybridized at 68° C. for 12 h using ExpressHyb hybridization solution (Clontech). After removal of the probe and hybridization solution, the filter was washed twice for 30 minutes each time with 100 ml of buffer I (2×SSC: 300 mM NaCl, 30 mM sodium citrate pH 7.0, 0.05% SDS) at room temperature and then three times for 60 minutes each time at 50° C. with 100 ml of buffer II (0.1×SSC, 0.1% SDS) with continuous shaking. Finally, the filter was rinsed several times with 0.05×SSC and analyzed by autoradiography. BAC-DNA was prepared by alkaline lysis, starting with a 10 ml culture volume. The resulting DNA was first treated with RNase (Sigma-Aldrich) at 30° C. for 3 h and then with plasmid safe DNase (Epicentre Technoligies, Madison, Wis.) at 37° C. o/n. After heat inactivation at 70° C. for 10 min the DNA was precipitated with 1 volume isopropanol for 30 min on ice and recovered by centrifugation at 1,880×g for 45 minutes to separate the remaining smaller fragments from the large, intact BAC plasmids. The final pellet was washed with 70% EtOH and redissolved in 80 μl water. This method typically yielded about 100 μg of BAC DNA.

DNA Sequence and Analysis. The AHBA biosynthesis gene cluster DNA sequence is described in SEQ ID NO:3. The DNA and deduced protein sequences were analyzed with Sequencher 4.1 (gene Codes Corporation) and MacVector 6.5.3 (Accelrys) software, and compared with sequences in the public databases using the CLUSTAL W (Thomson et al.) and BLAST (Altschul et al.) computer programs. TABLE 2 above provides details of the open reading frames of the deduced protein sequences of SEQ ID NO:3. No aminoDAHP synthase (ahba2) is found in or near the ahba cluster; nor is one yet found near the gdm cluster; while one pathway homolog (ahba3; a DHQ synthase) is found in both clusters. A similar situation holds true for the reported ansamitocin cluster and a distantly linked ahba cluster in the ansamitocin producer. In this case also no ahba2-family homolog is present in either cluster, while a different pathway homolog (ahba5; AHBA synthase) is found in both clusters. FIG. 6 shows the AHBA biosynthesis gene cluster open reading frames, and secondary structure marking the end of the cluster. Open reading frames 8, 9 and 10 are shown to confirm that these sequences not forming part of the biosynthesis cluster mark the end of the cluster.

Example 5

Disruption of the gdmH Gene

This example demonstrates disruption of the gdmH gene involved in methoxymalonyl-ACP biosynthesis. The gdmH gene was disrupted by introducing pKOS279-37 into the *S. hygroscopicus* NRRL3602 strain by conjugation from its *E. coli* ET12567/pUB307 host according to a published method (Flett et al., 1997, *FEMS Microbiol. Lett.* 155: 223–29). Exconjugants resistant to apramycin (PKC1139 carries the accIV(3) gene) and kanamycin were isolated and one of them was grown at 30° C. in 6 ml of R5 liquid medium (Kieser et al., 2000, Practical *Streptomyces* Genetics: *A Laboratory Manual*. The John Innes Foundation, Norwich UK) supplemented with 100 μg ml$^{-1}$ of kanamycin for 2 days in 50-ml culture tubes at 200 rpm. Approximately 5% of this culture was transferred into 6 ml of fresh R5/apramycin liquid medium and the culture was grown at 37° C. for 3 days in order to force chromosomal integration of the gdmH gene disruption vector, pKOS279-37.

(pKOS279-37 was made as follows: The aphII neomycin/kanamycin resistance gene from Tn5 was excised as a StuI-SmaI fragment from SuperCos-1 (Stratagene), then inserted into the MscI site within gdmH carried in a 4-kb BstXI fragment, containing the gdmN, gdmH and gdmI genes, and cloned in pOJ260 (Bierman et al., 1992, *Gene* 116: 43–49) to give pKOS246-33. The XbaI-EcoRI fragment from pKOS246-33 was excised and cloned into the XbaI-EcoRI sites of pKC1139 (Bierman et al., 1992, *Gene* 116: 43–49) to give pKOS279-37.)

After recovery of the mycelia by centrifugation, cells were plated on tomato paste medium containing 100 μg ml$^{-1}$ kanamycin and grown at 30° C. for sporulation. Spores collected from these plates were diluted and replated on the same medium for single colonies. Among 100 colonies screened, 20 were apramycin sensitive and kanamycin resistant when assayed on plates containing apramycin or kanamycin, using 60 or 50 μg ml$^{-1}$ of antibiotic, respectively. Genomic DNA was isolated from 11 of these 20 colonies by an established method (Kieser et al., 2000, Practical *Streptomyces* Genetics: *A Laboratory Manual*. The John Innes Foundation, Norwich UK) and probed by Southern-blot hybridization (Kieser et al., 2000, Practical *Streptomyces* Genetics: *A Laboratory Manual*. The John Innes Foundation, Norwich UK) with the aphII gene to determine that all kanamycin resistant recombinant strains had the restriction fragment pattern upon digestion with PstI-EcoRV expected for integration of the aphII gene into the gdmH locus by a double crossover recombination (hybridizing bands at 2.9 and 3.2 kb that were absent in the NRRL3602 strain).

To determine geldanamycin production, each of the 11 strains was individually cultured in 35 ml of the geldanamycin production medium (DeBoer et al., 1970, *J. Antibiot.* 23:442–47) as described above. After 4 days, 500 μl of broth from each flask was mixed with 500 μl of methanol, the mixture was centrifuged at 12,000 rpm in a desktop microcentrifuge for 5 min to remove mycelia and other insoluble ingredients, then the supernatant fraction was analyzed by HPLC/MS. The results showed that geldanamycin was present (retention time and low-resolution MS data were identical to the reference standard) and that two new compounds were present with molecular masses and formulas of 518.2759 ($C_{28}H_{40}NO_8$[M–H]$^-$) and 520.2916 ($C_{28}H_{42}NO_8$ [M–H]$^-$), calculated on the basis of high-resolution MS data. These data are consistent with 4,5-dihydro-7-descarbamoyl-7-hydroxygeldanamycin and its hydroquinone form. Production of geldanamycin suggests that the gdmH is dispensible or that its mutation is compensated in trans by a paralog.

Example 6

Replacement of AT Domain in Module 7 of gdmA3 in *S hygroscopicus* NRRL 3602

This example, and EXAMPLE 7, describe the substitution of AT domains in the geldanamycin PKS with heterologous domains. Plasmid and phage (not shown) delivery vectors were constructed by cloning DNA flanking the AT domains to be substituted in the gdmPKS. The heterologous AT domain used for the substitution was inserted between the flanking fragments and the vector was introduced into the geldanamycin producing organism. Replacement of the gdmAT domain occurs through stepwise double crossing over (homologous recombination). Analogous methods can be used for substitution of additional, or different, domains.

A DNA fragment (~1.3 kb) flanking the AT7 domain was PCR amplified from cosmid pKOS256-107-3 with the following oligonucleotides (EcoRI, BglII, XbaI, BamHI, PstI, HindIII, and NsiI restriction sites are underlined):

```
AT7 Left Flank
                                        [SEQ ID NO:63]
for   5'-TTGAATTCAGATCTACGTCACTGCGCGGACAGGAGGTC

[SEQ ID NO:64]
rev   5'-TTTCTAGAGGATCCGCCGTGGGTGGTGGCGTGGCCGGTG

AT7
Right
Flank
                                        [SEQ ID NO:65]
for   5'-TTTCTAGACTGCAGCGCGGCGGTCCGGGCGACGTCCGT

[SEQ ID NO:66]
rev   5'-TTAAGCTTATGCATCGGGTCGGTGACCTCGGCGGTGTC
```

The PCR fragment for the targeted AT was cloned together using XbaI into pUC19 using EcoRI and HindIII restriction sites. The resulting plasmid was pKOS309-8 (AT7 flanks). The rapAT2 casette (McDaniel et al., 1999, *Proc. Natl. Acad. Sci. U.S.A.* 96, 1846–51) was inserted between the two flanking sequences of the plasmid with BamHI and PstI restriction sites. The AT and flanking fragments were moved into the delivery vector pKC1139 (Bierman et al., 1992, *Gene* 116:43–49) with EcoRI and HindIII restriction sites. The delivery plasmid (pKOS309-23) contains the rapAT2 cassette flanked by 1.3 kb of gdm DNA for homologous recombination into the appropriate module.

The plasmid was introduced in *S. hygroscopicus* NRRL3602 by conjugation using *E. coli* ET12657/pUZ8002 (Kieser et al., Practical *Streptomyces* Genetics: *A Laboratory Manual* (The John Innes Foundation, Norwich, UK, 2000). Primary exconjugants were first grown in 5 ml liquid R5 containing 100 mg/l apramycin (apra) at 30° C. for 2 days. To generate the first crossover, 0.2 ml of these cells were used to inoculate 5 ml R5 with apra and grown at 37° C. for 36 hours. This step was repeated once and cells were plated on R5 agar with apra or Tomato agar with apra at 37° C. Single colonies from these plates were grown and their DNA analyzed by Southern blot for integration of the delivery plasmid by homologous recombination. Confirmed single crossovers were propagated in R5 without antibiotic selection at 37° C. for ~32 hours, plated on Tomato agar plates at 30° C. and allowed to sporulate (~10–14 days). Spores were harvested, plated on R5 and single colonies were screened for sensitivity to apra. To identify second crossovers (AT replacement), apra sensitive colonies were grown in geldanamycin production medium (DeBoer and Dietz, 1976, *J. Antibiot.* 29:1182–8) at 30° C. for 5 days. LC-MS was used to identify production of new geldanamycin compounds. Strain K309-1 containing the AT7→rapAT2 substitution was found to produce at least three new geldanamycin analogs that were purified and characterized by NMR spectroscopy. Those strains producing new metabolites were further analyzed by PCR and/or Southern blot to verify the expected replacement of the targeted AT domain in the gdm gene cluster.

Example 7

Replacement of AT Domain in Module 5 of gdmA2 in *S. hygroscopicus* NRRL 3602

A DNA fragment (~1.3 kb) flanking the AT5 domain was PCR amplified from cosmid pKOS256-107-3 with the following oligonucleotides (EcoRI, BglII, XbaI, BamHI, PstI, HindIII, and NsiI restriction sites are underlined):

```
AT5 Left Flank
                                        [SEQ ID NO:67]
for   5'-TTGAATTCAGATCTGTGTTCGCCGGGGTCATCTACCAC

[SEQ ID NO:68]
rev   5'-TTTCTAGAGGATCCGCCGTCGCTGCCCGTCTCCCCGGTG

AT5
Right
Flank
                                        [SEQ ID NO:69]
for   5'-TTTCTAGACTGCAGCCCGCCAGGACACCGACGCGGGCC

[SEQ ID NO:70]
rev   5'-TTAAGCTTATGCATGGCGTTGCCCGCCGCGTACGGGGC
```

The PCR fragments for each targeted AT were cloned together using XbaI into pUC19 using EcoRI and HindIII restriction sites. The resulting plasmid was pKOS309-6a (AT5 flanks). The rapAT2 casette (McDaniel et al., 1999, *Proc. Natl. Acad. Sci. U.S.A.* 96, 1846-51) was inserted between the two flanking sequences of the plasmid with BamHI and PstI restriction sites. The AT and flanking fragments were moved into the delivery vector pKC1139 (Bierman et al., 1992, *Gene* 116:43–49) with EcoRI and HindIII restriction sites. The resulting delivery plasmid (pKOS305-152) contains the rapAT2 cassette flanked by 1.3 kb of gdm DNA for homologous recombination into the appropriate module.

The plasmid was introduced in *S. hygroscopicus* NRRL3602 by conjugation using *E. coli* ET12657/pUZ8002 (Kieser et al., Practical *Streptomyces* Genetics: *A Laboratory Manual* (The John Innes Foundation, Norwich, UK, 2000). Primary exconjugants were first grown in 5 ml liquid R5 containing 100 mg/l apramycin (apra) at 30° C. for 2 days. To generate the first crossover, 0.2 ml of these cells were used to inoculate 5 ml R5 with apra and grown at 37° C. for 36 hours. This step was repeated once and cells were plated on R5 agar with apra or Tomato agar with apra at 37° C. Single colonies from these plates were grown and their DNA analyzed by Southern blot for integration of the delivery plasmid by homologous recombination. Confirmed single crossovers were propagated in R5 without antibiotic selection at 37 ° C. for ~32 hours, plated on Tomato agar plates at 30° C. and allowed to sporulate (~10–14 days). Spores were harvested, plated on R5 and single colonies were screened for sensitivity to apra. To identify second crossovers (AT replacement), apra sensitive colonies were grown in geldanamycin production medium (DeBoer and Dietz, 1976, *J. Antibiot.* 29:1182–8) at 30 ° C. for 5 days. LC-MS was used to identify production of new geldanamycin compounds. Strain K309-2 containing the AT5→rapAT2 substitution was found to produce at least two new geldanamycin analogs. Those strains producing new metabolites were further analyzed by PCR and/or Southern blot to verify the expected replacement of the targeted AT domain in the gdm gene cluster.

Analogs were not detected in experiments using constructs having substitutions of gdmAT2 with rapAT2, rapAT14, and eryAT2; gdmAT3 with rapAT2 or rapAT14; gdmAT4 with rapAT2; and gdmAT7 with rapAT14. This was likely due to the specific boundry junctions used for the domain substitutions in the constructs. Those of skill in the art will appreciate that by using constructs with different boundries polyketide producing cells can be generated.

Example 8

Construction of Mutant Geldanamycin PKS Expression Plasmids Using the RED/ET Cloning Procedure This example describes the use of the RED/ET cloning procedure for replacement of the AT4 domain of geldanamycin module with a heterologous AT domain (rapAT2).

Plasmid pKOS331-178 is a derivative of pKOS279-69 in which the gdmAT5 domain is replaced with the rapamycin AT14 domain using the same boundaries for the gdmAT5 domain as above. Plasmid pKOS272-166 contains point mutations in the KR6 domain of gdmA3 that generate the same KR inactivating Tyr4→Phe substitution used for inactivation of the KR6 domain in DEBS (Reid et al., 2003, *J. Am. Chem. Soc.* 42:72–79).

Figure 9:
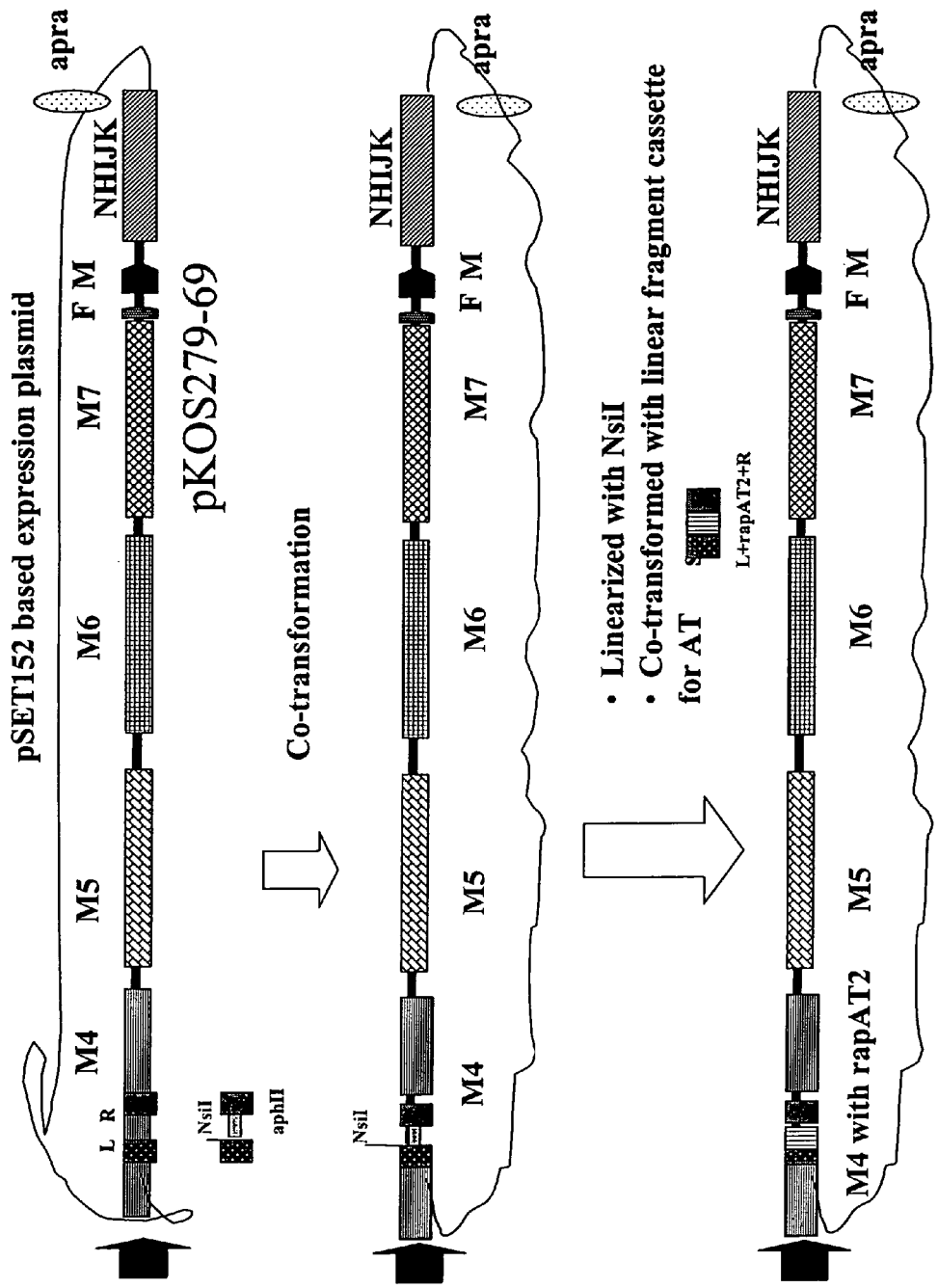
FIG. 9 illustrates a recombinational cloning strategy for domain replacement in PKS genes.

Plasmids pKOS331-178 and pKOS272-166 were constructed with a procedure based on RED/ET recombinational cloning (Datansko & Wanner, 2000, *Proc. Natl. Acad. Sci. U.S.A.* 97, 6640–45). The general strategy is outlined in FIG. 9. A unique restriction site is first introduced at the site of the targeted domain into the recipient PKS expression using an antibiotic (neo) resistance gene. The resulting plasmid is linearized using the unique site and cotransformation with the delivery DNA containing the modified cassette with flanking sequences homologous to the targeted plasmid. FIG. 9 shows the method for construction of PKS domain modifications in the gdmPKS expression plasmid pKOS279–69, using as an example the replacement of the AT domain of geldanamycin module 4 by a heterologous AT domain (rapAT2).

For plasmid pKOS331-178 (AT5→rapAT14) a neo marker was first cloned into the XbaI site of pKOS309-6a (described above) between the gdmAT5 flanking fragments to make pKOS331-74A. A linear fragment was obtained by digesting pKOS331-74a with HincII and isolating the fragment containing the neo marker and gdmAT5 flanks. The linear fragment was then co-transformed with pKOS279-69 into electrocompetent *E. coli* HS996/pSC101/BAD/γβαA cells (Gene Bridges). Eight apra/neo resistant colonies were screened and five were found to contain the neo marker recombined at the appropriate location of pKOS279-69. One clone was selected and designated pKOS331-124. The neo cassette introduced unique NsiI and AvrII restriction sites that were used to linearize the plasmid for the second co-transformation/recombination step. The delivery vector for this step, pKOS305-124A was constructed by inserting the rapAT14 cassette into the BamHI and PstI restriction sites of pKOS309-6a. A linear fragment was prepared by digesting with HindIII and EcoRI and isolating the fragment containing the rapAT14 cassette with the gdm flanks. This fragment was used with linearized pKOS331-124 to cotransform *E. coli* HS996/pSC101/BAD/γβαA cells. Eight apra resistant colonies were screened by restriction analysis and one clone was found to contain the correct gdm AT5→rap AT 14 substitution (pKOS331-178).

The same procedure was used to generate pKOS272-166 beginning with pKOS279-69. A neomycin marker was first introduced into gdmKR6 by RED/ET cloning to generate pKOS272-153. To construct the plasmid used in the second recombination step, pKOS272-122, two fragments were PCR amplified from gdmA3 with the following primer pairs and cloned into pKC1139:

```
left half forward,
5'-CGGGATCCGAGCCCCAACTGGCGGTGCGCGGT; [SEQ ID NO:71]

left half reverse,
5'-GCGGAGAAGTTGCCCTGGCCGGGCCCGCCTAGG [SEQ ID NO:72]
ACTCCGGCGGCGGACGAGTACA;

right half forward,
5'- CCGGAGTCCTAGGCGGGCCCGGCCAGGGCAAC [SEQ ID NO:73]
TTCTCCGCCGCCAACGCCTATCTGGA;

right half reverse,
5'-GCTCTAGAGGGTCCGTTGGGCGCGGTGAGGCC. [SEQ ID NO:74]
```

Recombination between linearized pKOS272-153 and pKOS272-122 as above resulted in pKOS272-166.

Example 9

Production of Geldanamycin and Analogs by Gene Complementation in *S. hygroscopicus* NRRL3602

This example describes construction and use of a host/vector system in which one or more gdm PKS genes are disrupted or deleted in the chromosome. Those same genes are then cloned into a plasmid or vector that can be used to deliver them back into the strain. They are under control of a native or heterologous promoter that results in expression of the genes and production of geldanamycin or an analog if they have been modified (gene complementation). It will be appreciated that this strategy is generally applicable to other domains.

Plasmid pKOS279-69 contains the gdmA2 and gdmA3 genes under control of the ermEp* promoter in the *Streptomyces* integration vector pSET152 (Bierman et al., 1992, *Gene* 116:43–49). A 7.8 kb NheI-PstI fragment (carrying module 4 and part of module 5) from pKOS256-107-3 was cloned into Litmus28 (New England Biolabs) to make pKOS313.57.1. At the same time, an AvrII-XmnI fragment generated by PCR with the primer M4F (5'-T<u>CCTAGG</u>ACATATGGCGAATGACGAGC) [SEQ ID NO:75] and primer M4R (5'GCGTC<u>GAAGAGG</u>TTCTCCAG) [SEQ ID NO:76] (restriction sites AvrII and XmnI in M4F and M4R, respectively are underlined) was cloned into PCR4Blunt Topo (Invitrogen) and was further cut and used to replace the AvrII-XmnI fragment in pKOS313.57.1 to make pKOS279-68. The NdeI-PstI fragment from pKOS279-68 and an XbaI-NdeI fragment (carrying the ermE*p promoter) of pKOS159-8 (Rodriguez et al., Apr. 16, 2003, Rapid engineering of polyketide overproduction by gene transfer to industrially optimized strains. *J. Ind. Microbiol. Biotech*) were ligated together and inserted into XbaI-PstI sites of Litmus28 to give pKOS279-68B. The final plasmid, pKOS279-69, was made by ligating the EcoRI-PstI fragment from pKOS179-68B, PstI-PstI fragment of 22.7 kb in size from pKOS256-107-3 with EcoRI-NsiI linearized pKOS159-8.

A gdmA2.gdmA3::neo derivative (K279-48) of NRRL3602 was constructed using a protocol similar to above with the delivery plasmid pKOS279-48. Plasmid pKOS279-48 was made by inserting the SpeI-XbaI fragment of pKOS279-46B into the XbaI site of pKOS279-46A. pKOS279-46A was composed of two fragments from the gdm PKS cluster cloned into the EcoRI-HindIII sites of pKC1139. The left fragment consisted of a 1.3 kb region upstream of AT4 amplified with the following primers: forward, 5'-TTGAATTCAGATCTAGTTCGCTGGAGGA-CAGCGACGTC; [SEQ ID NO:77] reverse, 5'-TTTCTA-GAGGATCCGCCGTCTGTTCC GGTCTGTCCGGTG [SEQ ID NO:78]. The right fragment consisted of a 1.3 kb region downstream of AT7 amplified with the following primers: forward, 5'-TTTCTAGACTGCAGCGCGGCG-GTCCGGGCGACGTCCGT [SEQ ID NO:79]; reverse, 5'-TTAAGCTTATGCATCGGGTCGGTGAC-CTCGGCGGTGTC [SEQ ID NO:80]. Plamid pKOS279-46B was made by inserting the aphII (neo) gene containing StuI-SmaI fragment of SuperCos 1 (Stratagene) into the EcoRV site of pLitmus28 (New England Biolabs). Introduction of plasmid pKOS279-48 into *S. hygroscopicus* NRRL3602 followed by screening for double crossovers resulted in strain K279-48 in which the gdmA2 and gdm A3 genes have been disrupted by the neo resistance gene. This strain does not make modules 4–7 of the gdmPKS and therefore does not produce geldanamycin. Introduction of plasmid pKOS279-69 into K279-48 restored geldanamycin production to levels comparable to the NRRL3602 strain.

The K279-48 and pKOS279-69 host/vector system was used to generate two engineered gdmPKSs that produced geldanamycin analogs. As described in Example 8, plasmid pKOS331-178 is a derivative of pKOS279-69 in which the gdmAT5 domain is replaced with the rapamycin AT14 domain using the same boundaries for the gdmAT5 domain as above. Plasmid pKOS272-166 contains point mutations in the KR6 domain of gdmA3 that generate the same KR inactivating Tyr→Phe substitution used for inactivation of the KR6 domain in DEBS (Reid et al., 2003, *J. Am. Chem. Soc.* 42:72–79). Both plasmids were constructed using a modified RED/ET cloning procedure described in Example 8. Introduction of pKOS331-178 into K279-48 resulted in production of the same 6-desmethoxy compounds as the gdmAT5→rapAT2 substitution described in Example 7. Introduction of pKOS272-166 into K279-48 resulted in production of at least two putative derivatives of geldanamycin as determined by mass spectrum and chromatographic retention.

Example 10

Inactivation and Heterologous Expression of Tailoring Genes

GdmL and GdmM are believed to encode mono-oxidases involved in post PKS oxidation steps (tailoring enzymes). Disruption of these genes in the geldanamycin PKS is expected to result in novel, geldanamycin-related, compounds due to loss of the oxygens at position 17 and/or position 21 of geldanamycin (resulting in a benzo-aromatic system instead of a p-chonoid system as in geldanamycin). See, for illustration FIG. 2. Homologous recombination was used to disrupt these genes.

a) Gdm M Disruption

For the Gdm M disruption, DNA fragments up- (fragment M1) and downstream (fragment M2) (FIG. 3) from GdmM were amplified by PCR introducing restriction sites, for M1 BamH1/Xho1 and for M2 Xba1/Nsi1, flanking the fragments M1 and M2. The aphII neomycin/kanamycin resistance gene from Tn5 was excised as a Xho1/Xba1 fragment from plasmid pFdneoS [Denis & Brzezinski, 1991, *FEMS Microbiol. Lett.* 81: 261-64] and ligated between M1 and M2 in vector pLitmus 28 (Invitrogen) to give pKOS 313-148. The cassette was then excised by a BamH 1/Nsi1 restriction to be then cloned into the pKC 515 [Kieser et al., 2000, Practical *Streptomyces* Genetics: *A Laboratory Manual*. The John Innes Foundation, Norwich, UK] based phage vector KOS305-117A phage DNA linearized by restriction enzymes BamH1/PstI to give pKOS K313175-6.

For the disruption of the Gdm M gene, pKOS K313175-6 was introduced into *Streptomyces hygroscopicus* 3602 by transfection [Kieser et al.]. Lysogens resistant to neomycin (disruption cassette includes aphII gene) were isolated and grown at 30° C. in R5 liquid medium [Kieser et al.]. The mycelia was then grown on tomato paste agar for sporulation at 30° C. for 18 days. To select for second crossover events which result in loss of the prophage and it's outside marker accIV apramycin resistance gene spores were grown on R5 agar and isolated colonies were patched out in parallel on R5 agar with neomycin (100 µg/ml neomycin) and apramycin (60 mg/ml) selection. Apramycin sensitive but neomycin resistance colonies were then transferred in 5 ml YPD broth [Sigma] as seed culture and grown in 50 ml glass tubes at 30° C. for 48 h. 1 ml of the seed culture was then transferred into 50 ml Geldanamycin production media (pH7) [DeBoer & Dietz, 1976, *J Antibiot* 29:1182-8] and grown in 250 ml baffled flasks with continous agitation for 6 days. The supernatant fraction of 1 ml crude extract/MeOH 1:1 mixture was then analyzed by LC/MS (analysis is ongoing). In 11 of the 12 analyzed mutants LC/MS data revealed two new compounds not present in *Streptomyces hygroscopicus* wildtype. Those compounds show fragmentation pattern similar to the geldanamycin sodium adduct and are detectable by UV at λ 304 nm.

b) Gdm L Disruption

For the Gdm L disruption, DNA fragments up- (fragment M1) and downstream (fragment M2) from GdmL have been amplified by PCR introducing restriction sites, for M1 BamH1/Xho1 and for M2 Xba1/Nsi1, flanking the fragments M1 and M2. The aphII neomycin/kanamycin resistance gene from Tn5 was excised as a Xho1/Xba1 fragment from plasmid pFdneoS and ligated between M1 and M2 in vector pLitmus 28 to give pKOS 390-6-1. The cassette was then excised by a HindIII/Stu1 restriction to be then cloned into the Hind3/EcoRV sites of pKC1139 [Kieser et al.] to give pKOS 390-7-1.

For the disruption of the Gdm M gene, pKOS 390-7-1 was introduced into *Streptomyces hygroscopicus* 3602 by conjugation from *E coli* ET12567/pUz8006 according to a published method [Flett et al., 1997, *FEMS Microbiol Lett* 155: 223-9]. Exconjugants resistant to neomycin (disruption cassette includes aphII gene) were isolated. Isolated neomycin resistant exconjugants are grown in liquid R5 media [Kieser et al.] at 30° C. for 2 days with neomycin selection (100 μg/ml). Approximately 20% of the culture is then transferred into 50 ml liquid R5 media [Kieser et al., 2000] with neomycin selection (100 mg/ml) and grown for 2 days at 37° C. in order to force chromosomal integration of pKOS. After recovery of mycelia by centrifugation, cells are plated out on Tomato paste agar at 30° C. for sporulation. Spores from these plates are diluted and replated on R5 agar to obtain single colonies. To select for second crossover events which result in loss of the plasmid (and the accIV apramycin resistance gene marker), isolated colonies are patched out in parallel on R5 agar with neomycin (100 μg/ml neomycin) and Apramycin (60 mg/ml) selection. Apramycin sensitive but neomycin resistant colonies are transferred in 5 ml YPD broth (Sigma) as seed culture and grown in 50 ml glass tubes at 30° C. for 48 h. 1 ml of the seed culture is then transferred into 50 ml Geldanamycin production media (pH7) and grown in 250 ml baffled flasks with continous agitation for 6 days. The supernatant fraction of 1 ml μl crude extract/MeOH 1:1 mixture is analyzed by LC/MS and novel geldanamycin-related compounds are identified.

```
GELDANAMYCIN CLUSTER
                                                                    (SEQ ID NO:1
   1 AGTCTAGGTC GGACTAGACC TTGTAAAACG ACGGCCAGTC CAGTGTGCTG GAAAGGCAAC

61 GCGTCGTCCG GGGCCAGGAC TTCGATCACC CGGTCCGCCA CCCGCCCGCG CACGCCCTTG

121 CCCGGCAGTG CGACGAAGTC GGCCACGGCC GGGAGGGGGT CTGCGGGATC GGTGCGCCGG

181 CCGTAGGCGG TGATGGCACG CCCCAGCGGG TGTTCCGATC CCTGTTCGAC CGCGCCCGCC

241 AGCCGGACCA GTTCCTCCTC GCCGAGTCCG CCCGGTGCAG CCGTGACCCG GGCGACGCTC

301 ATGTGCCCGG AGGTGAGGGT GCCGGTCTTG TCCAGGACGA CGGCGTCGAT GTGCCGCAGC

361 CCCTCCAGCG CCTGCGGTCC GCTGACCAGG ACGCCCAGTT GGGCGCCCCG GCCGGTCGCC

421 GCCATCAGCG CGGTGGGGGT CGCCAGGCCC AGCGCGCAGC GGCACGCCAC GACCAGGACG

481 GCCACGCTCG CGGTGATCGC CGCCTGCGGG TCGGCACCGG CCCCGAGCCA GAATCCGAGG

541 ACCGTGACGG CCAGGGTGAG CACGACCGGG ACGAAGACGC CCGCGGCCTT GTCCGCGAGC

601 CGCTGCGCCC GTGCCTTGCC CGCCTGGGCC TCGGTCACCA GCCGGGTGAT CCGGGACAGT

661 TGCGTATCGG CGCCCACCGC GGTGGCCCGT ACCAGGAGCA GGCCCCCTGC GTTGACGGCG

721 CCGCCGATCA CGGGCGTACC GGGGCCGACT TCCACCGGCT CGCTCTCCCC GGTGACCAGG

781 GAGAGATCGA CGGCCGAGCT GCCCTCCACC ACCGTGCCGT CGGTGGCCAG ACGCTCCCCG

841 GGCCGGGCGA CGAAGACCTG GCCGACCCGC AGTTCCTCGA TCGGGACCAG GCGCTCGCCG

901 TCGCCATCGC GTACCGACAC CTCCTTCGCC GCCAGCCGGG CCAGGGCGCG CAGTGCCACG

961 CCGGTCCCCC GCCGGGCCCG TGTTTCCAGG AAGCGGCCGG CGAGCACGAA CAGCGGTACG

1021 CCGACGGCGG CTTCCAGATA GATATGGGCG ACGCCGTCCG AGGCGGTGGG CACCAGGCTG

1081 AAGGGCATCC GCATGCCGGG ATCACCGGCC CCGCCGAAGA ACAGCGCGTA GGAGGACCAG

1141 GCGAAGGAGG CCGCGACACC CAGCGAGACC AGGGTGTCCA TGGTGGCCGC CGAGTGTCGC

1201 AGGCCGCGCG CCGCCCGCAG GTGGAAGGGC CAGGCTCCCC AGACGGCGAC GGGCGCGGCG

1261 AGCACGAAGC ACAGCCACTG CCAGTTGCGG AACTGCAGAC CGGGCACCAT CGACAGGACC

1321 AGCACCGGGA CCGCGAGCAA GGCCGTGCTC AGCAGCCGGT CGCGTTCCTG CCGGGCGTCC

1381 CGCGCCTCGT CCCCGTCCTC GCGCCGTTCC TTCGCCGGCG GCTCGGGCAG CGCGGCGGTG

1441 TAGCCGGCCT GCTCGACGGT GGCGATGAGC TGGTCCGGGC CGACCTCGGG CGGGTGGTTC

1501 ACCCGGGCCC GGCCGGTGGC GAGGTTCACG CTGCCGTGA CCCCGTCCAG CCTGGCCAGC

1561 TTCTTCTCGA CACGCTTCAC ACAGGCCGCG CATGTCATGC CGCCGATGGC GAGATCGGTC

1621 ACGACGGCCA CCGCTGCCGG TTCGCCGGCC ATCAGCGTCC ACTCCCCTGG TCCGTGTCCA

1681 TGCCACCCAT GTCCATGCCG CCACCGCCGT GGCCGTCTCC CGAGCCGCCG TCTCCCGAGC

1741 CGCCGTCTGT CGTGCTGGTG CCGTGCATGC CGGGGCGAC GGGCCCGGCG CCCGCGCCGA

1801 CGGCGTAGGA AGCGGCGAAC GCCATCACCA GCAGCAGAAG GAATCCGCAC AGCGCCGGCG

1861 GGGGCAATGC CCTGGTAAGG AACGCACCCG GCGTCCGGCG GGCAGATGGG CGGGGCTGCG
```

-continued

```
1921  CCATATGAGG AAACTCCCGA TCGCTCCGTA CGGCTTCAGC GGATCCGGCC GTACCGGTAG
1981  AGGAGTCGGA ACGGCCGGCA CCCGAGTTCC GACGCCTTGT CGTGACGCGC GTCACGACAC
2041  CAGGCTCGCC TGCCGAACGC GTGACCTGCT CAGCCCTGTT CATAGTGGCT CGGACTGCCG
2101  TCACGGTGGA CGAGACGGCC AAGCTGCTCC GCGCGGGCGC GGGGCATGAG AGTCCAGGTG
2161  CCGTCGGTGC GGTGCAGGGC GGCCGAGTGC CAGGGGGTGG CCCAGACGTC GGCGGCGTCG
2221  AGGAGGCGGA TGCCGAATTT GGGGGCGCCG ATGGGCTGGG GGTGGATGGA CAGCCGTACG
2281  GAGCCAGGGT GGTGCTCGGC GATCAGGTCG CCCCAGGCTC GGCTGCGCTG GATGACGCCG
2341  TAGGCGCGTG TGCGGCATTC GCGTTGGAGG GCGAGCGGG TGCCGGTGAA GTCGGCGGTG
2401  TCGTCGACGA GGAACCGGAT GATGCCCCGG TAGAGGGCGA GGGTGTGGTC CCCGGAGCGG
2461  ACCTCGGCTC GCAGCGCCTC CAGGGTGGGG GCGTACCGCT CGTGCACCTG GACGCGTTTG
2521  GTGTGGTGGG GCAGGTCGCC CAGGACGTCG CGCAGGTCGA AGACGGAGAG GCGGTGCAGG
2581  CCCGACTCCC TTATGAGACG TCTGAGTCCG TCCGCGTAGG CGTCTATGTG GTCGTCCGGG
2641  ACGCGGATCA GGTCGCCGAA GACATGGCCG TCGGAGCAGA TGATCACGCG GGCGCCCGGC
2701  GGGTGGACCC GCTCGATCTC CTCGCACAGG GTGTTCAGGA AGCCGAGGGA GAGGCGTTCG
2761  CCCTGGTCGG GGAGGTGGCC GAGGACCTTG GCGGGGTTGG GGGACTTGCA GGGGAAGCCG
2821  GGCAGGGTGA AGACCACAGG TTCTCCGGCG CGTACGAACC CGGCGATCTG GCGCCGCTGC
2881  TGCGCGAACG CCTCCGCCGC CGCGGGCGAG GGGTCGGTCG TGCGGTGGTA CGGCAGCAGC
2941  AGGTCCAGGA TGGCGGCGCT CATGCTGCTC GTGGAGCGGG TGTCCGGTGC GGTCGTCAGC
3001  GGCATGAGGT GGGTTCCTCC GTGAAGGTGT GCGCGACGCG GGCATGCGGG CATGCGTCAG
3061  ACGCGTCGGT CGTAGCCGAC CGGCAGGTGG TTGGTCCCCC GGCCGAGGAC GGCCGGGATC
3121  CACTCGATGT CCCGGTCTTC GATGGCCAGG TGCGCTCCGG GGAGGCGGGA CAGGAGGGTG
3181  CCCAGCGCGA TCTGGAGTTC GGCGCGGGCC AGGGCCGCGC CGGGGCAGAA GTGGATGCCG
3241  TGACCGAAGG CCAGGTGGGG GTTGGGTGAG CGGTCCAGGT CGACGGTGTC GGGGTCGGGG
3301  AAGCGGCGTG GGTCGCGGTT GGCGGCGCAC AGGGAGATGA TCACCGAGTC CCCGGCCGGG
3361  ACGTCCGTGC CGTGCAGGTC GCTGTCCTGG TCGAAGAAGC GCCAGGTGGT CAGCTCGAAG
3421  GCGCTGTCGT AGCGGAGGAG TTCGTCGACC GCGCGGGGCA TCAGCTCCGG GTCGTCGCGC
3481  AGCGGGCGA GTTCGGCGGG GTGGCGGAAG AGCGCGATCA GGGCGGTGGT GATCTGGTTG
3541  GTGACCGGTT CCTGGCCCGC CACGAGGAGC TGGAAGATCA TCGAGTCCAG CTCCTCCTGG
3601  GAGAGTTCGC TGCGGTCGCG GGCCACGACC AGGCGGCTGA GCAGGTCGTC CTCCCCGTGT
3661  TCGCGCTTAT GGGCGACGAC CTCGGCTATG TAGCTCTGGA GCCCGTGCAG GCGGGCCTCG
3721  TACAGCGGGC GTCCGGGGTC GGTCGGTCCG ACCGGCTGGA CGACCTTGCC CCAGTCGCGG
3781  TCGAAGCGGG CCGCCGACTC CGGTGGCAGG CCGATGACTT CGGCGAGGAC CTGCAAGGGG
3841  AAGCGGGCGG CGAAGCCGGT GACCAGGTCC GCGGGGCCGG TTTCCGGGAG GCGTCGACG
3901  AGGGTGTCGG CCAGCTCCTG GAAGCGGGGC CTCAGATGCT CGACGCGGCG CGGGGTGAAG
3961  GCGTCGGTGA CGAGGCGCCG CATGCGGGTG TGGTCCGGCG GGTCCTGGTG GAGGAGGTGG
4021  ACCTGGAGCT GGGAGTGCTG GGGCTCGGGC ATGATCGAGG CGCGGGCGCG CCAGCGGTCG
4081  TTGCCCCGGT CGTGGTTCTT GCCGAGGCGG TCGTCGCCCA GCGCGGAGTG CGCGGCGTCG
4141  TAGCCGGTGA CGAGCCAGGC GTGGACGCCG CTGGGAAAGC GGACGCGGTG CACCGGGCCG
4201  GTCTCGCGCA TCCGCTCGTA GAGGGGGTAC GGGTTGCTCT TGTAGGGGCA GCCCATCAGC
4261  GGCACGGGCT CGGGCAGGGC CTCGGGGGTC GTCCCGGATT CCTGGAGGGT CATGGAAGGT
```

-continued

```
4321 GCTCCTCAGA GGGCGAGTTC GGGCTGGTAG TGGTCCAGCC ACAGGGCCAG GTCGACGACG

4381 CGTTCGAGGC GGAGGCGGTG GCCCCACTCC AGTTGACCGG GCGGGGTGTC GAGGCAGGGT

4441 TTGACGCGGG TCTCGTCGGC GAGGGAGCGG ACGGTGTCGT CGGCGAGGGC GTCGCGGGCC

4501 ATGTTCTGCA GGCCGCGGTT GTAGTCGGGG TGATGGGTGG CCGGGTAGTG GTTCTTGGGG

4561 CGGTGCAGCA CCGAGTCGGG GGCCAGTCCG GTACCCGCGG CGCGCAGCAG GCTCTTCTCC

4621 CGGCCGTCGA AGTTCTTCAG GGTCCAGGGT GTGGTGAAGG CGTACTCGAC GAGCCGGTGA

4681 TCGCAGTAGG GGACGCGGAC CTCCAGGCCC TGCGCCATGC TCAACCGGTC CTTGCGGTGG

4741 AGGAGTTGAC GCAGCCAGCG GGTGAGCGAA AGGTGCTGCA TCTCGCGCTG CCGGTGCTCG

4801 GTGGGCGTCT CGCCGTCGAG GTGCGGTACG GCGGCCAGGG CGGTGCGATA GGTGTCGGCA

4861 CGGAACTCGC CGATGCGCAG GTCCAGTTCG GGGTTGAGCG GCATCGCGGC CTCGTCGCCG

4921 GTCACCAGCA GCCAGGGGAA CGTGGACGCG GCGAGCGCCT TGGGGTTGTG GAACCACGGG

4981 TAGCCGCCGA AGACCTCGTC GGCCGCCTCG CCGGACAGGG CGACCGTGGA GTGCTTCCGG

5041 ATCTCCCCGA AGAGGAGGTA GAGCGAGGTG TCCATGTCGC CGACGCCGAT CGGCGAGTCG

5101 CGGGCCACGA CCACGGCCTT GCGGTGCTCG GGGTCGAGCA GGGCACGCGG GTCCAGCACC

5161 ACCGTGCTGT GGTCGGTGCC GATGAACGCG CCCGCTTCCG TGGCGTACGG GGTGTCGTGG

5221 CCGGTGCGCA GAACATCATC GGTGAAGCTC TCGGCCTGGT CGCTGTAGTC GACGGCGTAG

5281 GAGCGGATAC GGGCGCCCGG GCCCTCGCGC AGCCGCAGTT CGTCGGCGAG CAGGGCGGTC

5341 AGGACGGTGG AGTCGATGCC GCCCGACAGC AGGGAGCACA GGGGGACGTC GGCCTCCAGC

5401 TGAGCGCGGG CGGCGGCGCT CACCAGGTCG TGCACGCGGG CGACGGTCGC GTCCCGGTCG

5461 TCCGGGTGGG CGTCGGCCGC CAGCCGCCAG TAGCGGCGCT CGCGGATGCC GTCCCGGTCC

5521 AGGAGGAGCA GACCGCCGGG CTCGACCTCC CGCACGCCGG ACCACACCGT CGGACCGGTG

5581 TTGAACAGCA GGCCGTACGC CTCGCGCAGC CCGTCCGCGG CCACCCGGGG CCGTATCTCC

5641 GGGTGGGCGA AGAGCGCCTT GGGTTCGGAG GCGAAGGCCA GACCGCCGTC CACGCCCGCC

5701 CAGAAGAGGG GCTTGACGCC GAGCCTGTCG CGGACCAGGA GCAGCCGCTG TGCCCGCTCG

5761 TCCCAGACGC CGAACGCGAA CATGCCGTCC AGGTGGTCGG CCACCTCCTC GCCCCACTCG

5821 GCGTAGCCGC GCAGCACCAC CTCGGTGTCG CTGCGGGTGC GGAACTCATG TCCCCGGCCC

5881 TTCAGTTGTG AGCGGAGTTC GTGGTGGTTG TAGATCTCGC CGCTGTAGGT GAGCACGGTC

5941 GTCGGGGCAT CGGGCCGGTC GGTCATCGGC TGGACGCCAC CGGCGATATC GATGACGGCC

6001 AGGCGGCGGT GGCCGATCGC GGCACGCGGG CCGAGCCAGA CTCCGTCCGC GTCGGGGCCG

6061 CGCGGGGTCA GGGTGGCGGT CATGGCCTCG ATGACCGGGG CCTGGGTGCG GGGGTCCTGA

6121 TGGAAGGACA CCCAGCCGGT GATTCCGCAC ATGGGCACGA CTCCTCGGTG AGGCTCGGGC

6181 GGTGGCTCAG CGGGGTGCGG CGGGCGCCGC GTCGGTGGTC TTCTCGGTGA GGTTCGCGGG

6241 ATCGCGGGCG GGCCGGGCGA GCAGCGGTAC GGCGAGGCAG GCGGCGAGGG CGGCGAGGGC

6301 CAGACCCGCC CGTACGCCGT CGTCCTGGCC GGCCGGCCCC CAGGCCGCCG TGGCCAGGGC

6361 CGGTCCGAGC GTGAAGCCGA GGCTGCGGGC GAGCTGGACG GTCGAGCCGA CCGTGGCGGC

6421 GCGGCCCGGC GGGGCGGCGC CCATGACCAG GGCCTGCACC GGGCCGCCGT TCAGGCCCAT

6481 GCCGAGTCCG GCCAGGGCGA GCCGCCAGGC GACGTCGGGA GGGGACCAGC CGTCGCCCAG

6541 CGGGACGAGC AGCAACAGGC CGCCGGCGGT GAGCGCGGCG CCGGTGACCG CGACGGGCCG

6601 GGCCCCGTAC CGGTCGGCGA GCCGTCCGCC GAGCGGGCCC GCCAGCCCCA TGCCGAGGGG

6661 GAAGGCGAGC ACCGTCAGGC CGGTGGTGGT GGCGCTGACG TCCTCGTCGC GCTGGAGGTG
```

-continued

```
6721  CAGGGCGACC ACGTAGTGCA TGGCGGCGAA ACCCACCGCC AGCGCCAGCA CCGCGCCGTG

6781  CGCCCGCAGC AGCCCCGCCG CCCGCAGCAC ACCGGCCACC GGACGGCCGC CCGGACCCCG

6841  CAGCCACCAC CACAGCGGCG GTGCGGCGAC GAGGGCGAGC GGCAGCCAGG CGGGTGTGTC

6901  GGAGGCCAGG GTCAGGGACA GCAGCAGGAT CGTTACTCCG GTGGCTATCA GGGCGGTGTC

6961  GCCGAGGAAG CGCCGGTCCG CGCCGCGCAG GCGGCCGTCC CGGGGCATCG CCCGCCACAC

7021  CACGGCCAGC GCCAGCAGAC AGAACGGGAT CTTGACCAGG AAGATCCAGC GCCAGCCGAG

7081  CTGGTCCAGG AGCAGACCGC CGACCGCCGG TCCGGTGACG GCGCCCAGGG GGCCGAGGGT

7141  CGCGGGCACG CTCATCGCCC GCCCGCGCGA CTCGGGCCGC ACCGAGCGGA TCGCCAGCAC

7201  CGGCATCGAC ACGAACAGCA CCGCACCGCA CGCGCCCTGC CCGATCCGGG CGGCGATCAG

7261  CCAGGCGGCC CAGGGGGACG CGGCGGCAAG CGCGCTGCAC AGCGCGAAGC CACCGGTGGC

7321  GGCCATCAGC GCGGGGCCGG TGCCCACGCC GTCGAGCCAG CGGCCGACGG GCAACAGGAG

7381  TGCGACGACG GGAAGTTGGT AGCCCAGTAC CGCCCACTGG GCTGTCGCCC CCGGTACCCG

7441  CAGGCCCTGG GAGATGTCCG CGAGCGCCAC GTTGACGATA TTCATGTCGA GCATCGCCAC

7501  GAACGCCAGC GCGCCCGCCA CGGCCACCAG GAGCCAGCGG TCGTGGACTT CGGGTGGATC

7561  CGCCGGACGC TCGGTTACGT CCCCGGGCTG ATCCGCACCG AAGCGTCGT CGGTCATACG

7621  CCCCTCCCTC TGGCCGGTCG GCCGCCGAGC GACGGCCTCG CTGTAGAAGT CGGGCGAACC

7681  GCGGAGTGAG TTCCCGGATG TATCAGGAAA AACGGCTGGA TTTCATAGTT CTCGGTGGTC

7741  GAAGGCGATC AGCGGGTCCC CGGTCAGCGG GTGCTCGACC ACGGCGGCGC GCACGCCGAA

7801  CACCTCGGCC AGCAGGGCCG GTCGCAGCAC CTCGCGGGGC GTTCCGGAGG CGACCACGCG

7861  GCCCTCGTGC AGGACATGCA GCCGGTCGCA CACGGAGGCG GCGGCGTTGA GGTCATGCAG

7921  CGACACCAGG GTCGTACGGC GTCGGCCGCG CAGCAGGGCG AGGAGTTCGA CCTGGTGGCG

7981  GACGTCGAGG TGGTTCGTCG GCTCGTCCAG GACCAGGACG TCCGTCCGCT GGGCGAACGC

8041  ACGGGCCAGC AGCACGCGTT GGCGCTCACC GCCGGACAGC TCGGTGAAGT GGCGGTCGGC

8101  GTGGTCCCCC ATGCCGACGT CCGCGAGAGA GCGCTCGACG ATGTCCCGGT CGGCGGCGTC

8161  CTCCCCGGCG AACGCCCGCT TGTAGGGCGT GCGGCCCATG GCGACGACCT CACGTACGGT

8221  CAGCTCGAAG TCCCCGCCCC GCTCCTGCGG GAGCGCGGCG ACGTGCCGGG CCGACCGCGC

8281  GGGGCTCAGC TCGCGGATGT CGGTGCCGTC GAGCAGGACA CGTCCGGCGG CGGGCTTCAG

8341  ATGCCGGTAC ACGGTCCGCA GAAGAGTGGA CTTGCCACTG CCGTTGGGCC CCACCAGGCC

8401  GGTGATCTCG CCTTCGGCCG CGATGAGGTG GGCATCGGCC ACGACCGTAC GTCCGGCATA

8461  CGCGACCCGC AGGTCCTCGA TGTCGATCCT CAACTCCCGC TCCCCAAGCG CCGGTCCAGC

8521  AGATACAGCA GCGCCGGAGC GCCGATCAGC GAGGTGACGA CCCCGACCGG CAGTTCCTGC

8581  GTGTCCATGG CCGTGCGGCA CACGATGTCG ACCACCACCA GCAGCAGCGC GCCGAAGAGC

8641  GCCGACACGG GCAACAGCCG ACGGTGGTCG CCGCCGACGA CCAGACGGCA GACGTGGGGG

8701  ACCATGAGGG CGACGAAGGC GATGGCCCCG GAGACCGCGA CGAGGACACC GGTGAGCAGG

8761  CTGGTGACCG CGAACAGCTC ACGGCGCAGC CGTACGACGT CGATGCCGAG CCCGGCCGCC

8821  GTCTCGTCGC CCATCAGCAG CGCGTTCAGG CCCCGGGCCC GGGCCTGGAG CAGCAGCAGG

8881  ACCGCCGGAA CCGCCACCGC CGGGGCGGCC AGCAGCGCCC AGCTCGCGCC GCTCAGGCTG

8941  CCCATCAGCC AGAACAGCAC ACTGTGGGTC TGCTGCTCGT CCCCGGCCTG GAGGACGAGG

9001  TAGCTGGTGA AGCCGGACAG GAACTGCCCG ATGGCCACCC CGGCGAGCAC CAGCCTGAGC

9061  GGTGCGAATC CCCCGCCACG TCGTGCCACC GCCCAGACGA GAGCGAAGGT GGCCAGGGCT
```

```
-continued
 9121  CCCGCGAAAG CGGCACCGGA CAGGCCGAGG CCCAGCGCTC CCCCGGCGCC GAGGCCGAGG
 9181  ACGATGGCGG CGACGGCACC GAGGGAGGCG CCGTTGGAGA CGCCCAGGAA GTACGGGTCG
 9241  GCCAGCGGGT TGCGGACGAG GGCCTGCATG GCCGTACCGA CCAGGCCGAG CCCGGCACCC
 9301  ACCAGACCGG CCAACAGGGC GCGGGGCAGG CGTAGTTGCC ACACGATCAG GTCATTGGTG
 9361  CCGGGCCGGG GGGCATCGCC GGTCAGTCTG CGCCAGACCA CGCTCCACAC CTCGCCCGGC
 9421  GGGATCGACG TGGAACCCCA GGCGACCGCC GCTGTGAGGG CCGCGAGCAA CGCGACCGCC
 9481  AGGAGCAGCG CCAGCGGCCC GGCGGGCACG GAACGCCGCG TGCGTGCACG GGCATCGGTG
 9541  CCCTTCCCGC TCACCGTGGC GTCGAGCGCC ATCAGCCGAC CTTGCCCGGG TAGAGGGCCT
 9601  TGGCGATCTC CTGGACGGCG TCGGCGTTCT CGACTCCGGC GATGGTGATC CGCTCGGAGC
 9661  CGATGCGCAG GAAGTGGCCC TCCTCGACTG CCTTCAGGCC CTTGGTGGCG GGGTTCGACT
 9721  CCAGCCACTT CCGCGCCTCG TCGAACGCCT TCTCGTTCGC CACCTCGCTG CCCCGATCAC
 9781  GGACGCCCAA CTGGATCCAG TCCGGGTTCC TGGAAATGAC GTCCTCCCAG CCGACCTGCT
 9841  TGTAGTCGCC GTCGCAGTCG GCGAAGACAT TGCGGGCACC GGCCAGAGTG ATCACCGCGT
 9901  TGGCGACCTG GCGGTTGCAG ACGACGGTGG GCTGCTTGGT GCCGGCGTCG TAGTCGAAGA
 9961  AGAAGTACGT CGGCCGCTCG CCCTCCGCCG TCCGGCCGAC GGCCTTGTGG ACGGCGTCCA
10021  CCTTCCCCTT CATTCCGTCG ACGAGTTCCT TCGCCTTCGC GCTGGTGCCG GTGACCGCGC
10081  CGAGGGAGGT GATGTCGCCC TCCACCGCGG ACAGGTCGGT CACCGCGCGT GTGTTCCGCG
10141  CCGCACAGGC GGTGGACTTG AGGTAGATGT GCTTGATCCC GGCCGCCTTG AACTCCTCCT
10201  CGGTCGGCGC GTCGCCCATG CCGCCGCCCA TGTTCATCGA GGCGAAGGTG TCGATGTACA
10261  GATCCGCGCC GGAGCCGAGG AGCTTCTCCT TCGGGATCAC CGATTGGCCG AGCACCTTCA
10321  CCTTCCGCGC CTGCGCGTCG AGTTCAGCGG GCAGTGAGCC CTTGCCGGGC GGGAAGCCGG
10381  TGCCGATGAC GTTGTCACCG GCGCCGAGGC GGAGCAGCAG CTCCAGGCTG GAGGCGTTAC
10441  TGGTGACGAT CTTCTTGGGG GCGTTGGAGA ATATGGTTTT GGCGCCCATG CAATCGGTGA
10501  CGGTGACCGG GTAGTCGCCG GTGGCCGACT TCTCGTCAGC GGGGCCCGCT TTGTCACCGT
10561  CGCCACTGCC GCCTCCGTCG CCGCAGCCCG CCACGAGGAG GCCGCCCAGC ACGGCGGCCG
10621  TCGTACCCCA CCACACACGA GAACGCATCG AAACTCTCCT GGATCCACTT GATACACGGG
10681  TTGCCCCGGA TCAGTAGTCG TGGCGGATGC GGCATCGGTT CCCGCTCGTC GGGAGCCGGC
10741  GAGAGCCATG GTCACCGCGC CGGCCCCTCG GCTCGGCCGG GGTACAACC AGACCAGTAA
10801  GCGCGTACAG GCAGACTACG TACATGGCGT CGGTGACGCC CGGCTGATCG GGAGCGGCAG
10861  TTGATGGAGT CGACAGGAGA GATCGTGCAC CGCAATTTTC GCCTGGCTCT GGGGCGGCTG
10921  GCAGCCCTCG TCTGCGCGTC TGTCGTCGCC GTCACGGGCT GTGGCGGCGA CGACGAATCC
10981  GAGGCTCCGA AGCCGACCTC GAAGCCGACC GCCAACTCCG GGCTCGTACC TGTCGCCCAG
11041  GCCTGCGATG GCCTGTTCGA CGAGGCCATC GCGAAGGAGG CCCGGGGGCC GAACGGGCCC
11101  GGCAAGGTCT ATCCGGTCAA GACCGGGAGC ACCTCTCACG TGGCGAAGGC GCTGCGGGAG
11161  GAGTCGGCCA GGAGAAGCAC GCCCGAGGAC CTCTGCACCT TGACGGACCA GGCTGAGGGG
11221  AAGGAGCTGC TCGCCATCAC CGTGGCGTGG ACTCCCCACT CACCCCCGTC GGGCCAGTCG
11281  GCGCGCTACA CGACCACCGT CGGTCCGGAA GACGCCGGCA GGCTCCTCGT CACATGTGAC
11341  ATCGGCAGCG GCGGCGGGAC GGAATCGGGA GGCGGGACGG AATCGGGAGG CGATCGTTCC
11401  CTGGAGTTCG CCATGCGCGA CTACTTCACC GTCAGCGACC ACTCCCACGC CAAGCTGCTC
11461  ATCGCCTCGG CGAAGAAGAT AACGTCGCAG TTGAAGTGCC GGGAAACTCC CGAATACCCG
```

```
-continued
11521  GATCCGAAGG TTGTGGCACC GCCACCGAAG CGGGGGCTGC GGTAGCGCGG TCCTTTCACC

11581  TTGCGGCAGG TGATGGCGGT TTAATCGAGT CATGATCTAC CACGTCGTAC CGCTTGCCGA

11641  GTGGAACGCT GCTCCCGACC ACCCCTACAG CCCCGCATCC CTCACGGAGG ACGGTTTCAT

11701  CCACTGCTCT CCCGACGAGG AGACCACGCT GGCCGTCGTC AACGCCTTCT ACCGCGATGC

11761  GCCGAGGCCA CTGCTGGCGC TGCTCCTCGA CGAGGACCGG CTCACCGCGA GATGTGAATG

11821  GGAGGCCGCT GACCCCGCCC CGCCGCCCGG CGTCGCCGAG AACAGTCTGT TTCCCCATGT

11881  CTTCGGGCCG CTCAACCGCG ACGCGGTGGC GCGGATCCAG GAGGTCGCAT GGGACTCGGA

11941  AGGCCGGGCG GTGGGGCTGA CGGAGGTGAG CTGACGACGA GGGCCGTCAC AGTGGCGCGA

12001  GGCGGGCCTT GAGCAGGCAG AACTCGTTGC CTTCGGGATC GGCGAGGACG TGCCACTGCT

12061  CCTCCCCGGT CTGGCCGATG TCGGCCGGGC GCGCACCGAG CTTCAGGAGG CGTTCGAGCT

12121  CGGCGTCCTG ATCGCGGTCG GTGGCGTTGA CGTCGATGTG CAGCCGGGGT TTCCCGGGCT

12181  CCGGCTCGTC TCTGCGGCTG AGGATGATCG TCGGCTGCGG ACCGCCGAAC CCTTCACGCG

12241  GCCCGATCTC GAGGGTTCCG TCGTCCTCGC GATCGAGCAC CACGAAGTCC AGGACCTCGC

12301  ACCAGAACCG CGCCAGCACC TCGGGGTCGC GGCAACCGAG CACGAGTTCA CTGATACGAC

12361  ATGCCATTGA CGAAACCTAC TCTCGGCGTG GGAACTGCCG GGGGTGGCCG CACGCAGATC

12421  TCAGGGGCTC CCCGCAGTGA GGACTCTCGG GACCGTACCG GGCCAGGCGA GCAGTGGCGA

12481  ATGGATTTCA CGCCCTCGCC TGCCTGTGCG TCGTGGACGG CCGAGTACGG CCACCGCGGA

12541  GACACGCAGC CAACCCCAGC GCGCAGATCG GACTCGCCCT GCCCCTGACC GACTCGTTCA

12601  TCGCCTTGAG CGGGCCCCTG TGCGGACAGG ACTTCGTGGC GGCGGCCGCA CAGCGCAGAA

12661  GCTGGGCCTG CTCGGCTCCG ACGTCGGCGG CATCCGTGCC GCGTTCATCG ACGGCGTCGT

12721  GTAGACGTGC GCCACACGCC GTAATCGGCC GCGGTGGATC CCGGGTGTGG TGGTGGTACC

12781  GGTGACGTGA CCGAGCCTGC CCGCCGACCG GTCGCCGGAC CACCACTCCA AGGCAACTCG

12841  CCACCCAGTC GGCCCTGCTG GAACGCGGTC CGCTCCTCGA TCAGCTCGCG GACAGCGCCA

12901  CCAGGCTGAC CTCACCGGAG TCCCCTGCGT CGGCCTGGAT CGGCCTCGCC CTTTGCTTCG

12961  CGGGCGCCCT GCTCACGCCG TGCTCCAGCC GGTGGTCCGG ATCGGATGTC CTGGAATGCG

13021  AGAGGGCCCC CGGATGGTTC CGCGGGCCCT CGTGCGCCTA GGCATCGTCA GTGCGTGGCG

13081  GTCGCCACCG CCCGGCCCTC ATCGGCCGTC GCGGGCTTGG GGTTCAGCAA CCGCTCGGCA

13141  AGCTCACCGA ACAGGAGACC GAAACCACCC CACAGGACGA CCTGCATGGC CAGAGCGGAC

13201  AACCGGAACC GCCACAACAC GGTGGCGGGG AAGTCCCCCG GCACCTCGTT GACCACGGGA

13261  AGGAAGGCAT ACGCCAGCCC GACCACCACG GCGAACGCGG CCACCGCGGC CACGGTCGCG

13321  TACCAGGTGC CCAGCCTCGG GGCGAGCCGC TTGCCCACAA TGGTGACGCC CACCGCGAGG

13381  AGCACACTGA GCAGCATCAT CAGGAAATAC AGCGTCGTGC GCTTGCCGAT CGTGTCGCCG

13441  TTGCCGACCG CGGGCGGATT GGCCGGGTAC TTCAGGAACG GCACCACGTA GACCGCCAGC

13501  AGCGCGCAGC CGGACAGCAG CAGCGCGGTG GCCCGCGGGG TGAAGCGGCC GACGCGGCCC

13561  AGGGCGACGC AGTACGCGAG GGCGGCGATA CCGCCGAAGG CGATCCCGTA GACCAGGACA

13621  CCGGTGGCCA GCCCGGCCGT GGACTGCACA CCACGCGAGA CCAGCTCGAC CTCGTGCTCA

13681  TGCGCGGGAG CGTGGGCCCC CTCGAAACCG ATCGCGCGGT CGACGCTCGG CTCACCGAGG

13741  AAGTAGGCGG CGACCAGGGC GAGCACGCCG GCCCCAGAC CGGCGAGCAT GCCCCGGACG

13801  AGCAGATTTC TTACCATTGC GGAGTTCATG AGTGTGCGGC GTCCCTCGCG TCAGTGGCAG

13861  GGGAAACCGA GCAGATGACG GGCGTCATGC ACCCACTCAT GGACGTTCTC ACCGGAGACG
```

-continued

```
13921  ACCGCGGTGG CGCCCTGCTC GGCGCCGACG AAATACAGCA GGACCAGCAT CAGAATGCCG
13981  AAGAAAACCG CCCACGGAGC TATCGCCTTC AGCGGCAGCG TGGCAGGCAG TTCGGGCGTG
14041  GTGGCTGTGG GCTGCGCGAC ATGCTGCGCC ATGGCCAGGC CTCCTTAAGG GAGTTCGCGT
14101  CCCATCTCGG TGGAGCACAG GACGACGGCT ACGGGTCTGA CTACGAGAG ACCCCGTCCG
14161  GGACCTCTCG CTCACAGTGG CGCGACCGTG CCGGATTCCC ACCGGCTTCC GTCTTACCGT
14221  CGTCGATATC GCACCGACCG TACCGCGTGT CGGGTTCATG GCCAAGACCA GCCACCTGGC
14281  GAGACGCTGC GCTGGGGTGC CTGAGGACGG TGCGGGAGCC GGGGCCTGCC CCCGGGCAGG
14341  CCCTAAAGTC GCGGCATGCG TCCGTCCGCC GAAAAGCGGC AGGCCCGCAC GGCGGACGCC
14401  CCCGCCGCTG CGTTGACCGG CGCATGAGCG GGTGCTCGAG ACTTCTTGCC TACGATGTGC
14461  TGATGCAGGT GATGCGCACC GGTCTTGGCT CCCTCCCGGA CGACACCCCG TGACGGACCT
14521  GATCCGCCGA GCCCTGACCG GCCGAGCCGC CCGGACCACG CCGCTGCTGG TCGTCTGCGC
14581  CCAGCTCCCG GTCACCCACT GGGCGGGCAA CCGGCTCGAT CTGCGCCGCT CGATGACCAT
14641  CGGGCTGCTT CTCATCGCCG CCGGTTTCGC GGTGGTGGCC GCCGCGCGCC CTGCCGCCTG
14701  GACGGGCACG GTCGGATCGC TGCCCGCCGC GGGCTACGTC GTGCTGCTCA CCCTCGGCCA
14761  GATGCTGGTC GTCCCGGCCG CCCGCGCCTG GGTGCCCGAC CTCGCCGAGA ACGGTCGGCT
14821  CGGCCTCTAC ACCGGCGCGC TGTCCTCCGT CTCCGGCCTG ATCGTCCTCA TCGGCAGCTC
14881  GGCCACCGGC GCCCTGCTCG ACCTGGGCCT CCCGCCCGCC GCCCCTGGC TCGTCCTCGC
14941  GGCCGTCCCG GCCCTCGCGG TGACACCGCT GCCCCGCCGT CCGAATCAGC CCAGGGTGAG
15001  CAGTTCCTCG TAGAAGCCGC CGAACTCCCG TTCCCGGTCG ACGAGGTGGA TCTCCTGGAT
15061  CCAGTGGCAG CGGCGTCCGG CCTTGTCGGT GCGCCGCAGC GGGGTGTCGT TGTCGGGCGT
15121  GATGTACGAC TCCACGCGCG CGCCGTCGAT CGTCTCGTGC GGGAACTCCC CGACCAGGTG
15181  GCCGGCGTGC CAGCCGCCCA GCTCCCATCC GGCCTCGGTG CCAGCCGCT CGACCTCGGC
15241  GTGCAACCGC TTCCCGGTGA CTCCGGGTC GCTCTCGAAG AACCGCTTGC CTGCGTCGAA
15301  GACCTTGGGC AGATCGTCCC GCAGCCGGTG CTTGACCGGG TCATCGCCGA GGACGAAGGT
15361  CCGGCCGAAG TCGGCCTCGT ACTCTTCGAA GATCGGCCCG AGGTCGGCGA ATACGATGTC
15421  GTCCGTGCCG ATCACCCGGT CCGGCGGATT CTCCCGGTAC GGCAGGAGCG TGTTCGGCCC
15481  CGAGCGCACG ATCCGCTTGT GCCAGTGCCG GGTCGTACCG AACAGCTCGT TCGCCAGGTC
15541  CCGGATCCGG TCGCTGACCG CCCGCTCCCC CTCGCCCGGC GCCACCAGCC CGCGCCCCTC
15601  GATCTCCGCG AAGAGCCGTA CGGCCTTCGC CTGGGCATCC AGCAACCGTT CCGCGCGCGT
15661  GGGTTCGTCG TCCGCCATGG GCCCGACGGT AGGCTGCTAG ATCGTTTCCC GGCAACCGAA
15721  TTAGGCAGTC CTCAGTCGGC CCGGCCAGTC GCCGCCACCG TCACGCCCAG GCCGATCATC
15781  GCGAGGCCGC CCGCCCCGCC GACCATCGAA AGGCGGCGGT CCGAGCGGGC GAACCAGGAG
15841  CGGGCCGCCG AGGCGCCCAG GCCCCACAGG GTGTCCGTGA CCAGGCCGAT GGTGATCGGG
15901  ACCAGGCCCA ACACCATCAT CTGGACGGGA ACATGACCCA CCGAGTGGTC GACGAACTGC
15961  GGTAGCACCG CCGCGAAGAA GACGATGCCC TTCGGGTTGG TGACGCCCAC CAAAATGCCG
16021  TCCAGAATCG AACGCAGATC ACCACGCCGC TCATCGGCCG GAGCGTCCAT GTTCGCCACG
16081  CGCATCTCCC TGCGGTGCCG GAACGCCTGC ACACCCAGGT AGACGAGATA CGCCGCTCCC
16141  GCCAGCTTCA CGCCCATGAA CAGCGCCACC GAGCTCTCCA CCAGCGCGCC GAGGCCCCAG
16201  GCCACGGCGA TCACCAGGGC GTAGCAGCCG ATCACATTGC CGAGGACCGT CGCGAGCGCC
16261  GTGCGGCGGC CGTGTGCGAG GGCCCTGCCG ACCACGAACA GCACACTCGG CCCCGGGATC
```

-continued

```
16321  ACGATCACCA AGAGCGACAT CGCCGCGAAC GTGAGAACAC TCTCCGTGGA CACCACGTGT
16381  CCGCCACCTC CTGAATCGCT CCGTCCAGGG GACATACAAG CAGATGGTGG GTTGTCCGCT
16441  CCAGACCCAG GCCCCCGGCC GGGGCTCGCA AGAAAGGGGC CCCGGCCGGC GAGCCGGCTG
16501  CTTACGACTG AGCGCTGGAC ACGGGCGCGT TGAGGTTCTC GTGGACCGCG CGGGCGATGC
16561  CCTCGATGTT GGCGATGCCG TCGTCCATCG TGGCGTTGTC CTGCGAGAGC ACCGTGATCG
16621  TGTAGTCGTG GTCGCCGCCG GTGAAGGCGC CGAGGCTGTG CACCCGCCAG CCGTTCGTGG
16681  CCCGCTCCAG CCAGCCGTTC TTCACATGCA CCTGGGCGTC GCTCGGCGCG CCGGCCGGGG
16741  TGCCCCAGCG CTGCGAGGGG ATGACCTCGG CCGTCAGCTT CAGGATGTAG GCGCGGGAGT
16801  CATCGCTGAG CACCGGGTTG GTGTGGGTCA CCAGTTGGAG GAGCTTTTCC TCATCGTTCG
16861  CGGTGATCTG GGTGAGCCCC CAGTGGCCCT CGCTGTCGAG GGTGGTGTTG GTCATTCCCG
16921  CGGCCTGCAG GAACCCGTTG ATCTTGTCCG CCCCGAGCTG CTTCCACAGC GCGGTGGTGG
16981  CGTCGTTGTC GGACTCTGTG ATCATGGCGG TGGCATGGTC CTTCTCCTCC TGTGTCAGGG
17041  CGCGATTGTC CTTCTGCGCG TCCCACAGCA GGGTGCTGAG CACGGTCACC TTGACCGTGC
17101  TCGCGGAGTC GAAGTGCCGG TCCGCATCCA GAGTGCAGGT GGTGTTCGTG GTGCGGTCGT
17161  GGAGGCTGAT CGCCGTGGTG GCGGCGGAGC CCTCCAGCGC CGAATTGATG TCCTCGGAGA
17221  GCTTGTCGGC GAGTTCCGGC CGGTCCGAGG TGCAGATCGC CGCCTGCGGG GTGGCCGCGT
17281  GAGCCGACCC CGCCGAGGCG ATCGTCGGCA CGAGCACCCC GGCGGCCAGC ACCGCTCTTG
17341  TCGCCAGGGT GGTACGGGGA GGCTGGGTTA TTCGTCGGTG TCGACCCATG GTGCGCTTGT
17401  CCATTCGTTC GTGGGGCAGT TGGACACGCG GTGCCTGCGC TCCGTTGCGA AGACATCCGG
17461  TGCTCCGACC CTGGATGACG AGCCGGAGGC GGGTGAGGTT CACGAACGCG TCCGAGTCTC
17521  ACAAGATCGC TCCACAATAG GCACCGCGCC CGGGCGGGCC GGGCGCGGTG CGGCGGACGA
17581  ACTGGGCGGC GACGCCCAGG ACGGCGAAGA ACATCGAGTG GCCCGGCTTC CACGGCCGAC
17641  CCCGGCCCGG CTTCCACGGC CGACCCGGGA CCCGGTCAGC TCTGAATGGC CGTGAGGAAG
17701  TCTCCGAGGG CTCGCGCGAC GGCGCCGGGG GCTTCCGCGG GGAGCAGGTG GCCGGCGTCC
17761  GGGACAGTCG TCAGGGTCGC GTGCGGGATG TGGGGCAAGA GGTGTTCGCG CAAGATGTGC
17821  GGCGGCTCAA CCACGTCGTT CTCCGCGGCC AGCACCGTCA CCGGGACCTC GATACGCCGT
17881  GCGGCATCGG TGATGTCCCG CGCGATTCCA CGCAGGGGCC ACTCCTGCCG GGCCTCGGCA
17941  CCGGCGGCGA GGCTGTCGCG CTCCGCGGTG GCCCGCACTG CCTCGGCCAG CGGTGTGGCG
18001  GTCAGGACGT GGTCGAGGGC GTGCCCCACC GTCTCGGCCG AGTCATAGGC GTGTGACAGG
18061  CCCTGCCGGT ATTCCTCGGT CACCATGGCG GGCGGCTGGG GCGGCGCGGG CGCGACGAGC
18121  ACCAGCCCGA CCAGGCCGGC CGGTCGGCGG GCCGCGACGA GCTGGCCCGC CTTGCCGCCC
18181  ATCGAGTGGC CGACGAGGAC GAACGGCCCC GACACGCGCT CCTCGATCAC ACGGACGAGA
18241  TCGTCGGCGA GCTGGTCGAG GTGATAGGGG CCGGGCAGCG CCCGCGAGGT GCCCCAGCCG
18301  CGCTGGTCGA AGCGGACCGT CGCCTGCCCG GGCGGCAGGT GGCCGATCAC ACCGTTCCAG
18361  GTGTCGGCGG AGCCGCCCCA GTAGTGGGCA AACACCAGCG TCGGGCCCAT ATCGCCCCCG
18421  ACTCGCACGT CGAGCGACCC GCCCGCCACG GGAACTCTCG TTGTCATTTC CATCATCTTC
18481  GCGCCTTCCC TGTCGGCCAC GGAAGGCGAC TCCGTCATCC TGCCGCAGCT CTGAACCAGT
18541  AACCTGACCT GCCGATCAGG CTCGGAATCG ACCGTAGGCG AGGGGGTGTC CACTCCTTGG
18601  CGGAAAGGAA CACGTTCATT GTGGAAAACG GACACAGTGC GGTGCGGCAA CTGCGCTACC
18661  TGCCTGCCGT GGGATCGGCG TACGGGGTGG AGGTCCTCGA TTTCGCGGCG CTGCGTTCGA
```

```
                         -continued
18721   TGGACACCCA GCGCCGTCGT ACCCAGCCGC AGCGCCCCGA CTTCCATGTG TTCGCGCTGG

18781   TCGGTTCCGG AACCGGCAGC CACGAAGCGG ACTTCCACAA CTACCGGCTG GGGGAAGGCG

18841   GCGCCGTGTG GATCCGGCCG GGCATGGTGC ACCGCTGGAG CGATATCGAC GCCTGCGACG

18901   GCCCGCTGAT CCTCTTCCGG CCCGGCTTCC TTTCCGGCTT CACAGCGTCG GAGGCCACCG

18961   CGCCGGCGTG CTGGCACCTG GACCGGCAGC GCCTGTCCCT CGCCCTGCTC GCGGCCGAAC

19021   ATCTCGGCCG CGAGCACAGC ACGGCAGTGC ACACACCACG CCTGGCATCC CCCGTCCTGC

19081   TGTCCCACCT GCTGGCGGCA CTGATCCTGC GCGCACTCCC CGGCACACCG CCCTCAGTCG

19141   GCCCGGCAAG CCCCGGCAGC CGACCTACCG AAGTGTTCCG CGCCTATCGG GCCGCCGTCG

19201   AAGAGCGCTT CACCGACTGG CACCATGTGG CCGACTACGC GCGGGCATTG GGCTACGACG

19261   TACGCACCCT CACCCGGACA ACGCGTGCCG CCACTGGCAC GGGCGCCAAG ACATTCCTCG

19321   ACCAGCGCAT CCTGCTGGAG GCGAAACGGC TGCTCGCCCA CACCGACCTG CCGGTCAGCG

19381   GCTGCGCCCC ACGCCTCGGC TTCCGGGACG TCGGCAACTT CACCACATTC TTCCGTCGCC

19441   AGGCCGGCCT GCCCCCCGCC GCGTGGCGCG CCGCATACAG CACCGCAGGC GCACAAGGCG

19501   GCTGACCCGC CCTCAGCGGC CGGGGGTCTG GCGAGTCACT GTCGCGGGGC AGGTTCACTG

19561   TCGCGGGGGC AGGTGCCGCA ATCCGTTCTC CAGCAGGGCG AAGGCGTGTT CCATGTCGGC

19621   CACCGCACCC GCATAGCGCT CGTCGGCCGG CTCCCCGTAC GCCAGGCGTT CGGCGTTGTC

19681   CTGCGCCAAC GCCCAGTGGA CCGCGACGAT TTGGACGGCG GCGAGCCGCG CGGTGAGTTC

19741   CGGAGTGTCC GCCGTTTCCC GCAGTGCCTC AGTCAGTGCG CGCTCGGCGC CGGTCTTGAA

19801   CCCTGCCATC CGGGCCACCA GCGAGGGCGC GTCGAGGATC ATGCGGTGGA GCCTGCGCAC

19861   TTCGGGCTGG TCGTTCAGCC CGGTGATCGG ATCCCGCTCG CGCAGCCCCT CGAGGAAGTG

19921   CTCGCGCAGT GCGGTCAGCG GGGCGGTACG GGGCGGGCGG GCCCGCACGA CGCGTGCGGA

19981   TTCGGTCTCG TGGTCGGCCA GGCGGTGCAC CACGAGGTCT TCCTTCGTCG GGAAGTAGGC

20041   GAAGAGGGTG CGCTTGGACA CCTCGGCCCT CTCGGCCACC TGGGCCACCG AGACCTGGTT

20101   GAAGCCGTAT TCGAGAAACA GCGAGATCGC CGCGTCGGAG ATCGCCGCGT GGGTCCGCTG

20161   CTTCTTTCGT TCCCGTAGCC CTGGCTTGCC GTCCACGGCG TCCACGGTAG CAGAAAACTG

20221   CCCCTGGTAA ATTTCTGCAC CGGGTATATA TTTACCCCGA GTGAGCCGAG TCGCAGCGTT

20281   GAGATGAGAT GGAGTGACGG TGTTGACGGA GAGCACGACC GAGGTCGTTG TCGCGGGTGC

20341   GGGCGCGACC GGACTGATGC TGGCGTACGA ACTGGCTCTG GCCGGGGTCG AGACCCTGGT

20401   GCTGGAGAAG CTGCCCCAGC GGATCCAGCA GGTGAAGGGC GGCACGATTC AGCCCCGTAC

20461   CGCCGAACTG CTGGAGTCCC GCGGCCTGCT GGAGCCGATG CTGCGGCGGG CCATTGCGCG

20521   TGATCCGGTG GGCGGCAGTT TCGGGGCCCT GCCCGTGCCC TTGGACTGCG CCCCCTGGCG

20581   GACCGAGCAC CCCTTCCCGA TCGGGATCCC TCAGTGGGAG ATCGAGGAGG TGCTCGAGGA

20641   GCGGGCGACC GCCGCCGGAG CGCGGGTGCT GCGCGGCACC GCCGTCTCAG GGGTCGCGCC

20701   GGACGACGAC GGTGTGGTCG TCACGGCGGA CGGCCTGCGG GCGCGGGCTC ACTATCTGGT

20761   GGCGTGCGAC GGCGGCCACA GTACGGTGCG CAAACTGCTC GGGCTGCCGT TTCCCGGCAG

20821   GGCCGGAACG CATCCGGCGG TGCTGGCCGA TATCCGTCTG TCCGCCGTAT CCTCACTGGT

20881   GCCGCGGCAG ATGGGACTTA TGAGCACCAT GACCCGTCAT GCGCGCGGCT ACTGGTCCAT

20941   GCTGGTCCCT CTCGGCGGCG ACCGGTACCG GTTCACCTTC GGGCACGCGG ACCAGGCGGA

21001   CACCGCCCGC GACACCCCCG TCACCCACGA CGAGATCGCG GCCGCGCTGC AGGCCGTGTA

21061   CGGCCCTGAG ACCACCCTCG GCGCCGTGGA CAACTCCTCG CGGTTCTCCG ACGCCACGCG
```

-continued

```
21121  ACAACTGGAG CACTACCGCA CGGGCCGTGT CCTGTTCGCC GGGGACGCCG CGCATATCCA
21181  CCCCCCGCTG GGCGCCCAGG GCCTCAACCT CGGCGTACAG GACGCGCTCA ACCTCGGGTG
21241  GAAACTGGCC GCGGTCCTCC AGCACCGGGC GCCGAACGGC TTGCTGGACA GCTACCACGC
21301  CGAACGGCAT CCGGTCGCGG CCCAGGTCCT GCATCACACC TCGGCGCAAC GCGTCCTGGC
21361  GATTTCGAAC CCGAGCGAGG ACGTGGCCGC CCTGCGCGAC ATCTTCACCG ACCTGCTGCG
21421  GCTGCCCGAC ACCAACCGCC ATCTCGCGGG GCTGATGTCC GGCCTCTCGC TGCGCTACGA
21481  CCTGCCCGGC GATCACCCGC TCACCGGAGA GCGCATCCCG GACGCCGATC TGGTGACCGA
21541  AACCGGCACC ACCCGGCTGT CGACGCTCTT CGGCTCCGGA CACGCCGTCC TGCTCGACCT
21601  GGCCGGAGCC GTCCCGGCCG ACCTCCCGCT CCCGCCACGA GTCGACCTCG TCCGCGCCAC
21661  ATGCGCCGAC GACATGGGCG CCGCCGCCCT GCTCATCCGT CCCGACGGCT ATGTCTGCTG
21721  GGCTACGGAC ACCTCCGCCG CCTGCGGCGA CACCCTGCTG GCCGCGCTCA CCGGCGACCT
21781  CGCGAGGGTG CCCTGAGCCA GGTGACAATG CGCTGAGCCG GGTGACAAAG AGGACGCCTA
21841  CGCGAAGGCC CTCAGGGTGT CCTCGCCGTC GGTCCACCAG ACGCCGAGCC GTTGGCGGAC
21901  CAGGAGCCAG CCGTCCGGGC CCCGGCGGAA TTCCCAGTCG TAGGGGCCGC CCATGGAGTA
21961  GGGAGAGGAG GTGCTCCCGG GTGCGGTGAC GGCCACGAAC CACATGTAGC CGATCCCCGT
22021  CGCCCGGTCG CCCTCCACGT CGACGTGCAT GTTGAGGATG TGATGCTGCA TGCTCGCGTA
22081  CGGTGATTCC ACCTCCTCCA CCTTGGCCCG GACCGCCTCT TTTCCGTGGA TCTTCTCCCA
22141  CGGCCCGAAC TCCAGCACCG CGTCCTCGGC CCAGCATTCG ATCCAGGTCT GCCAGTCCTT
22201  GCGGTCCAGC GCACGCCATC CGCGGATCAT GAGGGCGCGC AGGGCTTCCT TGTCCTCCAG
22261  GGCGCGCAGC CGGCGGGCCA GGCTGTCGTA GTCGGCTGTC GCTGTCATGA CGGGCCTCTT
22321  TCGTCCATGG GTGGGGATCT GTCCTGCCCG ACCGAGTCTG GACCGGTCGA AGACCGCCGA
22381  CCAGGCCGAA CGCCGCCTAG GAGCACCGCA CCCAGGCGGC ACACCGGCGG ACTCATGGAG
22441  GGCAGTTGGG CAACGGCCAG GGGTGAGCCG ACCCCGGCCA TGTCTCCAGC AGGTCGGGGG
22501  GAAGATCTCC TCGCTCGTCC AGCGGTGTGT GGTCAGGCCC TGCTCGTGGT GGTAGCGATC
22561  CCGGTGCGCC GGCCTGGGTC GTGTCGTACC GGAACCGTGT GCCCGATCCA CCGTAAATCC
22621  GCCGGACGAG GCGACGTGGC CGCCGCACGC CATCGGGCGG CCGGAGCGGC CGAAGACCCC
22681  TTGTTCCCGC TGTCAGCCGC TGCCGCCGCC GTGGTCAGGG GGAATGAGGG GGATGTTTAG
22741  GGGACGGCCC GCTCGCTGCC GGAACAAGAA TCACAACAAC AGCAGCGAGC TTTCTCAAGC
22801  TCGTTCGAGC TTTCTCTCCC GGGCCTTCTT TCCCTTGGGC CGCGCAACCG GAGCGCGGCT
22861  GTCCCGCGCA AGGGCGATC CCGCGCGGGT CGGTCGCTCC TCCCGCGCGC CCTGCTTCGA
22921  ACCGAGAGGT GTGGCGGCAT GCTACGGACT GACCTGATCC GGCCGGTGCC CGAACTGCTC
22981  CGGGCCAACG CGGATCGCTT CGGTGACAAG CCGGCCTGTT CCGACGGACA CCGCACGGTC
23041  AGCCATGCCG AACTCGAACG CCGTACCCGG CGGCTGGCCG GTCATCTCGC CGGGCTGCGG
23101  CTGCACCCCG GCGACCGCGC CATGATCTGC CTGGGCAACC GCGTCGAGAT GGTGGAGAGT
23161  TACTTCGGCG TCCTGCGGGC GAACGGCGTG GCGGTGCCGG TCAACCCGCG TTCGACCGAT
23221  GCGGAACTCT CCTATCTGCT CGCCGACAGC GGCGCCCGGC TGGTGCTCAC CGATGTCGCC
23281  CACGCCGACC AGTTCGGCCG GCTGCGGGAA CAGTTCCCGG AGCTGAGGGT GGTGGTCAGC
23341  GGGGACGGCC CGCTGCCGAA GGGCTTCATC GCGTTCGAGC CGCTGCCGGA CACGGAGCCG
23401  CAGCTGGCAG CCCGCGACGA CCTGGGCCTG GACGAAATCA CCTGGATGCT CTACACCTCG
23461  GGCACCACGG GCCTGCCGAA AGGCGTGCTG TCCACACAGC GGAACTGCCT GTGGTCCCTG
```

```
23521  GCCGCCTGCT ACGTGCCGGT GACGGGGCTG ACCGCCGAGG ACCGCGTGCT GTGGCCGCTG

23581  CCGCTGTTCC ACAGCCTTTC GCACATCGTG TGTCTGCTGG CGGCCACCGC CGTCGGGGCC

23641  AGCACCCGGA TCGTGGACGG GGTGTCGACG GCCGATGTGC TGGACGCACT GCGCGAGGAG

23701  CGGTCGACCT TCATCGCCGG AGTGCCGACG CTCTACCACC ACCTGATCGA GGCGGCCCGC

23761  GAGCGCGACT TCGCCACGCC CGAGCTGCGG ATCGCGCTCG TGGGCGGGGC GGTGGCCACG

23821  GCGGACCTGG TCAGGTCGTT CGAGTCCGCC TTCGGAGTGC CACTCGTCGA CGCCTACGGC

23881  TCCACCGAGA CCTGTGGCGC GATCGCGGTG AACTGGCCAA CCGGCCCGCG GGTCGAGGGG

23941  TCGTGCGGGC TGCCGGTGCC GGGGCTGACG GTGCGGCTGG TGGACCCGGA CACCGGTGTC

24001  GACGTTCCGG CCGGGCGGGA AGGCGAGTTC TGGGTGTCCG GCCGAACAT CATGGCCGGG

24061  TACCACAACC AGCCGGAGGC GACGGCCTCG GCGCTGCGCG ACGGCTGGTA CCGCACCGGG

24121  GACCTCGGCC GCCGCGACGA GGCCGGATTC TGCACGGTGA CCGGCCGGAT CAAGGAACTC

24181  GTCATCCGGG CCGGGGAGAA CATCCACCCC GGTGAGGTCG AGGCCGTGCT GCGCACCGTG

24241  CCCGGTGTGG CGGACGCGGC CGTGGTGGGC AAGCCGCATG CGGTGCTCGG CGAGGTTCCG

24301  GTGGCCTTCG TGGTGCCCGG CCCGGACGGC TTCGACCCGT CGGCGCTGCT GGCCACGTGT

24361  CGCGAGCGGC TGTCGTACTT CAAGGTCCCG GAGGAGATCT ACGAGATCGC GCGGGTGCCA

24421  CGCACCGCCT CGGGGAAGAT CACCCGGCAC GTACTGCTGG AGCTGCCCGC ACGGCTGCGG

24481  GCCGCCGGAG ACGGCCAGTA CGACTCGCTG CTGCGGCTGG ATTGGGTGCC GCAGTCCGCG

24541  CTGCCGGACG CCCCGGCCGG GACCGGTACC TGGGCACTGG CGGACGCCGA CGCGCTCGGG

24601  CTCGCGGTGG GGCTGCGGGC GGCCGGAGTG GACGCGCGGG TGGTGGGCGA GCCGGTGGGC

24661  GAGCCGGTGG CCGACTCCGT GGCCGGTCTT GTGGCAGGCT CCGTGGCCGA TCTCGCTGGA

24721  GATGACGGTG CGGCCCCGGA TGTGGTCGTG GTGACGCCTC CGGTGGCGGG CCTCCCGGAT

24781  GAGACCGGGG CCCCTGACGA GGCCGGGGTC ACGGTTGGCG AGCGCGCCGA CCGGCTGGCG

24841  GCCCGCCTTG GCGCCTGGCT GGCCGACGAC CGGCTGGCCG GACGACGTT CGTGGTGGCC

24901  ACCACGGGCG CGGTGGCCAC CGGCGCCGAG GAGGACGCAC CGGAGCCGCT GTCGGCCGCG

24961  CTGTGGGGTG TGGTGCGCTC GCTGCAGGCC GCCTACCCCG GCCGACTGAC GCTGGTGGAC

25021  GTGGACCTGG ACGGGGCCGG GGACAGGGCC GGGGACGGGG CCGGGGAGGA CGGTCGGGAG

25081  GCCGCGCTGT TGCGGGCCGT CCAGGGCGGG CACGACCAGG CGGCGATCCG TGGCGGAGTA

25141  CTGCTGGTCC GCGCCTGAC CCGGATCTCG TTCCCCGCGG AGCCGGGGCC CGCCCCAACC

25201  CTGGACGCGG GCGGACTGGT CGTGATCACC GGTGGCGACA CCACCCGCGG CACCGCGCTG

25261  GCCCGCCATC TGGTGACCGC GTACGGCGCC CGTAACCTGC TGCTGCTCAG CGCGAATGGC

25321  CTGCCGGAAG AGGCGGCGGC CACGTTGCGG ACCGAGTTGG CGCGGGACGG GGCCCAGGTC

25381  TCGATGGCCG TATGCGACCC GGCCGACCGG ACGGCGCTGG ACTCGGTGCT GGACGCACAG

25441  GCCCGGCCGG TGACCGCTGC CGTACACATC GAGGAGCCGA GCCCGGAACG GTCGCTCGAC

25501  ACGTCGCTGC GCGCCATGAC ACACCTGGAA GAACGGACCC GGGGGGCCGC CCCGGCACTG

25561  TTCGTCGTCG TCACCTCCGC CGCCGGGGTG CTGGGCTCGC CTGGCCGCCC GGACCGGGCG

25621  GCCGCCGACC AGTTCGGCGA AGCCCTGGTG CGGCGGCGCC GGGCGCTTGG CCTTGGCGGG

25681  CTGGCTCTGG CCTGGGGCCC GCTGCCGGGC GAGCATGGCA CGGCGCCGGT GGCCGGTGCC

25741  GTTCCCCTGC CCGAGGCGCT GGCCCTGTTC GACGCGGCGC TGACGGCTGG TCAGGGGCCG

25801  CTCGTGCTGC TCAGGCCGAG CACGACGGGG CTGCCGGGTG GCGAGCCGGT GCCCGCGGTG

25861  CTGCGTCATC TGGTGGACGC GCCGTCCGGC GTACCGGCGT CGGACGAACC CGCCGTCGCG
```

```
                           -continued
25921 GAGTTCCGGC GGCGGCTGGC CGCCGAGAGC GAGTCCGGCC GACAGCGCAT GGCGCTGGCG

25981 CTGGTGCGCG AGCACGCCGC GGCGACGTTG GGGCTGGCCT CGGCCGACCC GGTCGAGGCC

26041 GGCCAGGCAT TCAGCGCGTT CGGCTTCACC TCACTGACCG CGGTCGCGTT GAGGAACCGG

26101 CTGAACGCGG CCACCGGGGC ACGGCTCGCC GCCACGGTGG TCTTCGACCA TCCGACCCCT

26161 GCCGGGCTGG CGCGGCATCT GGTGCGGGAG ATCACCGGGA GGCGCGGCGT GCAGGCGCCG

26221 GTGCGAGCGC GCGGCGTGTC CGACGAGCCG GTGGCGATCG TGGCGATGGG CTGCCACCTG

26281 CCGGGCGAGG TCGCGACGCC CGAGGACCTG TGGCGGTTGG TGGCCGACGG GCGGGACGCG

26341 ATCGCCGGGT TCCCGGAGGA CCGGGGCTGG GACCTGGCCG GGCTCTTCGA CTCCGACCCG

26401 GACGCCGTGG GCAAGTCCTA TGTGCGCGAG GGCGGTTTCC TCACCGACGC GGGCGGATTC

26461 GACGCCGCAT TCTTCGGCAT CTCGCCCCGT GAGGCGCTGG CGATGGACCC GCAGCAGCGG

26521 TTGCTGCTGG AGACCGCGTG GGAGACCTTC GAGAATGCCG GAATCGACCC GGGTTCGCTG

26581 CACGGCACCG ACGTCGGTGT GTTCAGCGGA GTGATGTACC ACGATTACGG GGCCGACGCC

26641 GGGACGGCGG CGGAGGGCCT GGAGGGGCAT CTCGGCGTGG GCAGCGCGGG GAGCGTCGTC

26701 TCCGGGCGGG TGGCCTACGC GCTGGGCCTG ACCGGGCCCG CGGTGACCGT GGACACCGCC

26761 TGCTCGTCCT CCCTGGTAGC GCTGCACCTG GCGGTTCAGG CGGTGCGCAC GGGCGAATGC

26821 TCGCTGGCGC TCGCCGGGGG TGTCGCGGTG ATGAGCAGGC CGACGTCGTT CATCGAGTTC

26881 TCCCGCCAGC GTGGCCTCGC CCCCGACGGC CGCTGCAAGT CCTTCGCGGA GGGCGCCGAC

26941 GGCACCAACT GGTCCGAGGG TGTCGGGTTG GTGTTGCTGG AGCGGCTGTC CGATGCCCGC

27001 CGCAATGGGC ATGAGGTGCT CGCCGTCGTC CGTGGCACCG CCGTGAACCA GGACGGCGCC

27061 AGCAACGGCC TGACCGCGCC CAACGGCCCG TCCCAGGAAC GGGTGATCCG GCAGGCGCTG

27121 GCGAACGCCG GGCTGACGGT GGCCGATGTG GACGCGGTCG AGGCCCACGG CACGGGCACG

27181 AGTCTCGGCG ACCCGATCGA GGCCCAGGCA CTCCTGGCCA CCTACGGGCA GGAGCGGCCG

27241 GAGGATCAGC CGCTGTGGCT GGGGTCGTTG AAGTCGAACA TCGGGCATGC GCAGGCGGCG

27301 GCGGGCGCGG CCGGTGTCAT CAAGATGGTC CAGGCCATGC GGCACGGCGT ACTGCCCAAA

27361 ACCCTCCACG CCGACGAGCC CACCAGCAAG GTCGACTGGA CGTCAGGTGC GGTGTCGCTA

27421 CTGTCCGAGG CCCGGCCCTG GCCGGAGACG GGACACCCCC GCCGCGCCGG PATCTCCTCC

27481 TTCGGCGTCA GCGGGACGAA CGCACACGTG GTCCTGGAAC AGGCACCCCT GGAAGCGGCT

27541 GCACCCGAAA CACAGGCGAG CGACGCGGGC GCTCCTGGGC TCGTGGCCAC GGGCGGCGTA

27601 GTGCCGTGGG TGCTGTCCGC CAAGACTCCT GCGGCGCTGC GCGCTCAGGC AGAGCGTCTG

27661 GTCAGCCATC TGGAGTCCGG GAGCGACGCC AACCCGGTCG ATGTGGGCTG GTCGCTGGCC

27721 ACCACCCGGG CGGCGTTGGA GCACCGCGCG GTCATCCTGG CGACGGATGC CGAAGGAGGC

27781 ATGGCGACGG CGCGGGCTCT GGCGGAGGGG CGGCCTGACC CGCTCCTGGT CACCGGACAG

27841 ACCGGAACAG ACGGCAAAAC CGTGTTCATC TTCCCCGGCC AAGGCGCCCA ATGGGTGGGC

27901 ATGGGAGCCC AACTCCTCAA CACCTCACCC GTCTTCGCCG CCCGCCTGCG TGAGTGCGCC

27961 GATGCTCTAG CGCCGTATAC CGACTGGTCG CTCATCGACG TCATCACCGG CACGCCCGAC

28021 GCTCCCTCGC TTGAGCGTGT CGACGTCGTA CAGCCCGCCA CCTTCGCCGT CGTCGTCTCC

28081 CTCGCCGCAC TCTGGCAATC CGTGGGCATC CACCCCGACG CCGTCATCGG CCACTCCCAA

28141 GGCGAAATCG CCGCCGCCTG CGTCGCCGGA CACCTCACCC TCACCAACGC CGCCAAAATC

28201 GTCACCCTCC GCAGCCAGAC CATCGCCCAC CACCTCGCCG GACACGGCGG CATGATGTCC

28261 CTCGCCACCC CCGCCGACAC CATCGACCTC ACCAACTGGC ACGGCAAACT CTGGATCGCC
```

```
                                           -continued
28321  GCACACAACA GCCCCAACGC CACCGTCATC GCAGGCGACA CCGACGCCCT GCACCAACTC

28381  CACACCCACT ACACCGACCA GGGCACCAGA GCCCGCATCA TCCCCGTCGA CTACGCCTCC

28441  CACACCGGAC ACGTCGACAC CATCAAAAAC CAGCTACAAG ACGTACTCGA CGGCATCACC

28501  CTCGAACCCG GCACCATCCC CTGGCTCTCC ACCGTCACCG GACAGTGGAT CGAACCCAAC

28561  ACCGTCGGCG ACAGCTACTG GTACCGCAAC CTCCGCCAAA CCGTGCAATT CGAGCACACC

28621  ATCCACACCC TCGCCGACCA GGGCTACCGC ACCTACATCG AAATCAGCCC CCACCCCGTC

28681  CTCACCACCG CCATCCAAGA AACCCTCGAA GCCAACGACA CCCCCAACAC CACCATCGTC

28741  ACCGGCACCC TCCGCCGCGA CGACGCACC CCCACCCGCC TCCTCACCAA CCTCGCCCAC

28801  CTCACCACCA ACGGAACACC AGTCAACTGG CCCACCCTCT TCACAGGCAC CCAACCCACC

28861  CGCATCCCCC TCCCCACCTA CCCCTTCCAA CACCACCACT ACTGGCTCCC CCGCAACACC

28921  AGCGCAGGCG ATGTGAGTGC CGTGGGCCTC CAGGGCACGG GCCACCCGCT GGCCGGGGCC

28981  GTGGTGAGCG TGCCCGACAC CGGGGGTGTG CTGCTCACCG GGCAGTTGTC GGTGGCCACC

29041  CACCCGTGGC TGGCCGACCA CGCCGTCTCC GGAACGGTGC TGCTGCCGGG CACCGCGATG

29101  GCCGAACTCG CCATCCGCGC CGGAGACGAG ACCGACACCC CCACCCTGGA AGAGCTGGTC

29161  ATCGGCCAGC CGATGACACT GCCCGAAGAC GGTGCACTAC ATGTCCAGGT ACTGGTCGGC

29221  GGCGTGGAGG ACGGGCGCCG AGGGGTGCGG ATCTACTCTC GCCCCGACGC GGCCCAGGAA

29281  CAGGAATGGC TGGAGCACGC CTCGGGCACA CTCGCCACGC AGCCGGACGG TTCGGCCGAG

29341  GGCGGCATGG AGAACGGCAT GCCCGAGTGG CCGCCGCCCG GTGTCGAGCC GATCGCTCTG

29401  GATGACTTCT ACGACGACCT CGCCCAGGCC GGGTATGAGT ACGGGCCCGC CTTCCGCGGG

29461  CTGAAGGCGG TCTGGAAGCG CGATGGCGAG GTGTTCGCGG AGGCCCCGCT GCCGGAGGAG

29521  CAGACGGACG TCGCCGGCCG GTTCGGTATC CATCCGGCGC TGCTGGACGC CGCGTTGCAC

29581  GCGAGCAACT TCTGTGTGCC CCCGGCCCCG GGCCAAACGC TCCTCCCCTT CGTGTGGAAC

29641  GGCGTACGGC TGCTGGCGGC GGGAGCCACG GCCGTCCGTG TGCGCGCCCG CGCCACCGGC

29701  ACGGACTCGT TCACGATCAG CCTGTTCGAC AGCACCGGCT CCCCCGTCGC CTCGGTGGAC

29761  TCCCTGGTGC TCCGGGCGAT CAGTCCCGAG CAGCTCGCTG CCGCCTCCGG CGGTGCCGGT

29821  CGGTCCGCTG ATGCGCTGTT CACGCTGGAC TGGACCGAGC ACCCCACCGC CCTGGGGACC

29881  GAGGTTTCCT GGGCCACCCT CGGCGATGCC CACACCGACG TGGACGCCCA CGTGGACGCG

29941  CTCATCGCGG GAGAGGACCG GCCCGGGGCC GTGGTCGCCG ACACCGCGGC CTGGGCCGCC

30001  GGGGACACCG GCCTGCCCGC GCGGGCCCGG GATCTGGCCG CCCGCGCGCT GGACCTGGTG

30061  CAGCGGTGGG TCGGCCGACC CGAACTCGCC GACGTCCGGC TCGTGTTGCT CACTCGTGGG

30121  GCGGTGTCCG TGCACGACAC CGCCGAGGTC ACCGACCCGG CCGCCGCCGC GATCTGGGCG

30181  CTGGTCCGCT CCGCCCAGTC CGAACACCCG GGCCGGATCG CCCTGGTGGA CACCGACGAC

30241  GTGTCGCGGG AGGCGCTGCC CGACGCGGTG GCGGCCGGCG AGCCGCAAGT GGCGCTGCGC

30301  CGTGGGCTGC TGTGGGTGCC TCGTCTGGTG CGGTCGCCGC AGGGTCTCGC CGTACCCGCG

30361  CACGAGCACT GGTACCTCGA CGTCTCGGAG AAGGGCAGCC TGGAGAACCT GGTGCTGCGG

30421  CCGGATCCGG AGGCCACCGC GCCGCTGGCC ACCGGTCAGG TCCGGATCGA GGTCCGCGCC

30481  GCCGGTCAGA ACTTCCGGGA CGTACTCGTC GCGCTCGGCG GCGTGGCGGG TCAGGAGGGT

30541  CTGGGCGGCG AGGGTGCCGG GGTGGTGACC GAGGTCGGGC CGGGGTCGA GGGCCTGGCG

30601  GTGGGCGACC GGGTGATGGG CCTGTTCCCG CGCTCGTTCG GCCCGCTGGC CATCGCGGAC

30661  GCGCGCACGG TCGCGCCGAT CCCCGAGGGC TGGTCGTACG CCACGGCCGC CGGGGTGCCG
```

-continued

```
30721  GTGGCCTATC TGACGGCACT GTACGGGCTG CGGGACCTGG GCACCGTACA GCCGGGTGAG
30781  ACGGTGCTGG TGCACGCCGC CGCGGGCGGT GTGGGCATGG CCGCCGTCCA GTTGGCGCGG
30841  CACTTCGGCG CCACCGTGTA CGCCACCGCC CACCCGTCGA AGCACCATGT GCTGACCGCG
30901  CTGGGGGTGC CGGAGGGGCA TCTGGCGTCC AGCCGCGACC TCGGTTTCGC CTCGGCGTTT
30961  CCCGCGCTGG ATGTGGTGCT GAACTCCCTC ACCGGCGAGT ATGTGGACGC CTCGCTGGGG
31021  CTGCTCGGCA CGGGTGGCCG TTTCGTGGAG ATGGGCAAGA ACGACATCCC CGATCCCGCC
31081  TCGGTCGCCG CAGCACATCC CGGTGTGGGC TATCAGGCGT TCGACCTGGG AGGTGACGCG
31141  GGCCCTGACC GGATCCGGGA GCTGCTCGCG GAGCTGGTGG AACTGTTCGA GGCGGGCCGG
31201  ATCGAGCCGC TTCCGATACG GCACTGGGAC GTCACCCAGG CGCCGACGGC CTTCCGGTGG
31261  ATGAGCCAGG GGCGGACACA CGGCAAGATC GTGCTCACCC TCCCCCGAGC CCTGGACCCG
31321  GACGGCACCG TCCTGATCAC CGGTGGCACC GGAACCCTCG GCGCCACCAT CGCCCGCCAC
31381  GTCGTCACCC ACCACGGCGC GCGCCAGTTG CTCCTCATCA GCCGTCAGGG TCCCGACGCC
31441  CCCGGCGCCA CCGATCTCAC CACCGAACTC ACCGAACTCG GCGCCACCGT CCGCATCACC
31501  GCCTGCGACA CCGCCGACCG CGACCAACTC GCCGCGCTCC TCGCCGACAT CCCCGCCGCC
31561  CACCCCCTCA CCGCCGTCAT CCACACCGCC GGCGCCCTGG ACGACGGTGT CCTGACCGCG
31621  CTCACCCCGG ACCGCCTCGA CACCGTCTTC CGCCCCAAGG TCGACGCCGT CACCCACCTC
31681  CACGACCTCA CCCGCGACCA GGACCTGGCC GCGTTCGTCA TCTACTCGTC CGCCGCCGGA
31741  ACGCTCGGCA ACGCGGGGCA GGCCAACTAC GCCGCCGCCA ATGCCTTCCT CGACGCCTTC
31801  GCCCAGTGGC GGCACGCCCG CCACCGGCCC GCCACTTCGC TGGCGTGGGG GCTGTGGAGC
31861  GACACCAGCA CGCTCACCTC GACGATGGAC GCCACCGACG TACGCCGCAC ACGGCGGGCG
31921  GGGGTGCTGG GCATGGACAA CGCCGAGGCG CTGCGGGTGT TCGACACCGG GTTGCGGTCC
31981  GGGCGGCCCG CGCTGGTGGC CGCGAAGATC GACCTCACCG CCCTGCGCGC GCCGGACGCC
32041  GAGTTGTCGC CGCTGCTGCG CGGACTGGCC CGTCCGGCGC GCCGCACCGC GCGCACCGCG
32101  GCCCCGGCGG CCGGTGGTCT GTCGGGGCAG CTGGCCGGGC TGTCCCCCGC CGGGCAGCGG
32161  GAGTTCCTGC TCAACCTGGT GCGGGCGGAG GCCGCGGTGG TCCTCGCCCA CGCCGGTCCT
32221  GAGGCGATCG AGCCGACCGT GGCGTTCAAG GAGATGGGTT TCGACTCGCT GACGGCGGTC
32281  GAACTGCGCA ACCGGCTGAA TGCGGCGACC GGGCTGCGGC TCCCCGCCAC GTTGCTCTTC
32341  GACCACCCGA CTCCGGCTCT TCTCACCGAG CTGTTCCATA CCGAGTTGGG CGGCGGCCCG
32401  GCACCCGCCG CGGCGGCCCC GGTGACCGTG CGTGCCGCCG CTGACGAGCC GATCGCCGTG
32461  GTGGCGATGA GCTGCCGTCT GCCGGGCGGG GTGACCGACC CGGACGGGCT GTGGAACCTG
32521  CTGCTCGAAG AGCGCGACGG CATCGCCGAC TTCCCCCGCG ACCGGGGCTG GGACTTGGAG
32581  GCGCTGTTCG ACGCCGACCC GGACCGGAGT GGCACCTCCT ATGTGCTGCG CGGCGGGTTC
32641  CTCGAGGACG CGGCCGGTTT CGACGCGGAC TTCTTCGGCA TCTCGCCACG TGAGGCGCTG
32701  GCGATGGACC CGCAGCAACG GCTGTTCCTG GAAGCCTGCT GGGAGGTGTT CGAGCGGGCG
32761  GGCATGGACC CGACGACGGT GGGTGGCGGC GACATCGGCG TGTTCGCCGG CGTCATCAAC
32821  CAGGACTACG GCGTGCGGAG CGGGCCCGCT CCCGAGGACC TTGAGGGCTA TATGCTCACC
32881  GGCTCGGCGA CGAGTGTCGC CTCCGGCCGG GTGGCCTATG TGCTGGGCCT GGAGGGCCCG
32941  GCGGTGACGG TGGACACGGC GTGCTCCTCC TCACTGGTGG CCATGCACTG GGCCGTACAG
33001  GCGCTGCGCC AGGGCGAGTG CTCGATGGCA CTGGCCGGGG GTGCCACGGT GATGGGGCGG
33061  CCGTCGGCGT TCGTGGAGTT CTCGCGCCAG CGTGCCCTGG CGCCGGACGG CCTGTGCAAG
```

-continued

```
33121  GCGTTCGGCG CGGGTGCCGA CGGCACCACC TTCAGCGAGG GTGTCGGGGT ACTGCTGCTG

33181  GAACGGCTCT CCGACGCCCG CCGCAACGGC CACGAGGTGC TGCCCGTGAT CCGCGGTACG

33241  GCGGTCAACC AGGACGGCGC CAGCAACGGC CTCACCGCCC CCAACGGCCC CTCCCAACAG

33301  CGGGTGATCC GGCAAGCACT CGCGAACGCC GGGCTGTCGG CCACCGACAT CGACGCCGTC

33361  GAAGCCCACG GCACCGGCAC CGCCCTCGGC GACCCCATCG AAGCCCAGGC ACTCCTGGCC

33421  ACCTACGGCC AGGACCGGCC GGGAGACGAG CCCGTATGGC TCGGCTCGCT GAAGTCGAAC

33481  ACCGGGCACA CGCTGGCCGC GGCAGGCGTG TCCAGCGTCA TCAAGATGGT GCTGGCGATG

33541  CGGCACGGCA CGCTTCCGCG CTCCCTGTAC GCCGACGAGC CCACGCCGGA AGTGGATTGG

33601  TCCCAGGGCG CGGTGTCCCT GCTCACGGAG GCCCGGCCCT GGCCGGAGAC GAGCCACCCA

33661  CGCCGCGCCG GGATCTCCTC CTTCGGCATC AGCGGCACCA ACGCCCACCT CATCCTGGAG

33721  CAGGCGCCCC AGTCCGAGAC CGAGCCCGAA GCCGCGCCGA AGGCGGACGG CGGCATGGAC

33781  ACCCCAGGGC TCGTGGCGAC CGGCGGGAGC GTGCCCTGGG TGCTGTCCGC CAAGACCCCC

33841  ACGGCCCTGC GGGCTCAGGC TCAACGACTC CTGGACCACC TGGAATCCGG GGTGACCGAC

33901  CGCCCCCTCG ACATCGGCTG GTCCCTGGCC ACCACCCGCA CCCTCCACGA CCACCGCGCC

33961  ATCATCCTCA CCGACACCGA GGGCGGTGAC GCCACAGCCG CCCTCACCGC CCTCGCGACC

34021  GGACAACCCC ACCCCCGCCT CACCACCGGC CACGCCACCA CCCACGGCAA GACCGTCTTC

34081  GTCTTCCCCG CCAAGGCGC CCAATGGCAA GGCATGGGAG CCCAACTCCT CGACACCTCA

34141  CCCGTCTTCG CCACCCGCCT CCACGAATGC GCCGACGCCC TCGCCCCCTA CACCGACTGG

34201  AACCTCATCG ACGTCATCAC CGGCGCACCC CACGCCCCTT CGCTCGACCG CGTCGATGTC

34261  CTGCAGCCGA CCACCTTCGC CATCATGGTC TCCCTCGCCG CACTCTGGCA GGCCAACGGC

34321  ATCCACCCCG ACGCCGTCAT CGGCCACTCC CAAGGCGAAA TCGCCGCCGC CCACATCGCC

34381  GGACACCTCA CCCTCACCGA CGCCGCCAAA TCGTGGCCC TGCGCAGCCA GACCATCGCC

34441  CACCACCTCA CCGGACACGG CGCCATGATG TCCGTCCTCG CCTCCCACAC CTGGGTTCAA

34501  GAAGCACTGG CTCCCTGGCA CGGACACCTG TGGATCGCAG CCGTCAACGG CCCCGCCTCC

34561  GTATCCGTCT CCGGAGACCC CGACGCACTC GCCGAATTCG GTGTCACCCT CTCCAAGGCG

34621  AAGGTCTACC GCTGGCAGTT GCCCGGGGTG GACTTCGCCG ACACTCCGG ACACGTCGAC

34681  ACCATCAAAG ACCAGCTACA CCACGTACTC GACGGCGTCA CCGCCTCCCC CGGCACCGTG

34741  GCCTGGATGT CCACCGTCGA CGCCGACTGG GCCAACCCCA CACACATCGA CGCCCACTAC

34801  TGGTACCGCA ACCTCCGCGA CACCGTCCGC TTCGAAGAAG CCACCCGAGC CCTCCTCACC

34861  CACGGCCACC GCGTCTTCAT CGAAATCAGC ACCCACCCCG TCCTGACCAC CGCCATCCAG

34921  GACACCACCG AAACCCTCCC CGAGGTCCGG GCCACCATCA CCGGCACCCT CCGCCGCGAC

34981  GACGGTGGCC CCGACCGCGT CCTCACGAGC CTCGCGGAGC TCTCCACCGC CGGAATTCCG

35041  GTCCACTGGC CCACCGCGTA CGCCGGAACC ACACCCTCCC AAGTCCCCCT GCCCACCTAC

35101  CCCTTCCAGC ACCAGGACTA CTGGCTGGCC GCCACCGGCC ACCACGGGGA TGTCGGCTCC

35161  GTGGGACTGC GCGACGCGGC GCACCCGCTG CTGGGGCCG TGGTCAGCGT GCCGGACACC

35221  GGAGGGGTGC TGCTCACCGG GCGGCTGGCA CCGTCGGCGC AGTCCTGGCT GGCCGACCAC

35281  ATGCTGTCCG GCGTCGCCCT GGTGCCGGGT ACGGCGATCG TGGAACTGGC CGTACGGGCC

35341  GGGGACGAGA CGGGCACGCC GGTGCTGGAG GAGCTGGTCC TCGGCCAGCC GATGCTTCTC

35401  CCCGAGGACG GCTCGCTTCA GGTGCAGGTC CTGGTCGGCG CTGCCGAGGA CGACGAGCGC

35461  CGTGCGGTGC GTGTCTACTC CCGCGGCGAC GAGTCCGAGC CGTGGGTCGA GCACGCGTCC
```

-continued

```
35521  GGCATCCTGT CCGCGCACGC GCTCGTTCCT GTCGAGGCAG AGCGGCAGTG GCCGCCCACC

35581  GGGGCGGAGC CCGTTGTCCT GGAGGGCTTC TACGACCGCC TGGCCCAGGC AGGCTATGAG

35641  TACGGTCCGG TGTTCCGCGG GCTCACCGCA GCGTGGACCC GCGGCGATGA TGTGTTCGCC

35701  GAGATCACCC TCGGCGAGGA CCAGCACGAC CTCGCGGGCC GCTTCGGGAT CCATCCGGCG

35761  TTGCTGGACG CGGCACTGCA CGCGAGCAAC TTCTGCCCGG GCAACGAGCC CGGCGGCGGG

35821  ACGTATCTGC CGTTCTCCTG GAACGGCGTG CAGTTGCACG CCGACGGCGC CACCGCCCTG

35881  CGGGTGCGGG TCACCTCCAC CGGGCCGGAC AATCTGTCCC TGCACGCGAC CGATCCGCAC

35941  GGGGTGCCCG TGGTGACCGT CGGCTCGCTG GTGCTCAGGG AGACCACCGC GGAGCAGCTC

36001  CGCACCACAT CGGCCACGTC CGCCGCGGAC TCCCAGTTCA CCGTGGAGTG GACCGAACAT

36061  CCCCTGGCCC GGGACGAGGT GGCGTGGGCG GCGCTGGAGG CCGTGCAGGA CGACCATACG

36121  TGGCCGCCGG TGGTCGTCGC CGACACCCGG GCGTTCGCCG CGCAGGGCGG CGGACTGCCG

36181  GACGAGGGCG GACTGCAGGA GGACGGCGAA CTACCGGAGC GCGCCCGTGA GCTGACCGGC

36241  CGGGCACTGG CCGCGATACA GCGTCTGATC AGCGACGACG CACTCGCCGA CAGCCGCCTG

36301  ACGCTGCTCA CCCGGGGTGG CATGGCGGTG CATGACGACA CCGAGGTCAC CGACCCGGCC

36361  GCCGCCGCGG TGTGGGGCCT GGTGCGCGCC GCGCAGGCCG AGCACCCGGG CCGGGTGTGC

36421  GTGATCGACA TCGACGACCG GTCGGCCGAG GCCCTGACCG CCGCGCTGGC CACGGAGGAA

36481  CCCCAGCTCG CGCTGCGGGG CGGAACCGCG TGGGTGCCCC GCCTGGTGCG AGCGCGCCCG

36541  GGACTGGCGG TCCCGGCGGC CGTGGCGTGG CATCTGGACG TCACCGAACA CGGCACGCTG

36601  GAGAACCTCG CCCTGGTGCC CCATCCCCGG GCGGAGGCAC CGCTGGAGGC GGGCCAGGTG

36661  CGGATCGCGG TGCGCGCCGC CGGCCAGAAC TTCCGCGATG TGCTCATCGC CCTCGGCATG

36721  TACGAGGCGG AGATCGGCAC CGAGGGCGCC GGCGTGGTGA CCGAGGTCGG CCCGGGCGTG

36781  GCGGACCTGA CCGTGGGCGA CCGCGTGATG GGCATGTTGC CCGGTTCGTT CGGGCCGCTG

36841  GTGGTGGCGG ACCGGCGGAC GGTGGTGCGG ATGCCGCGCG GCTGGTCGTT CACGGCTGCG

36901  GCCGGGGTGC CGGTCGCCTA TCTCACCGCG TTGTACGCGT TGCGGGATCT GGGCGATGTC

36961  CAGCCGGGTG AGACGGTGCT GGTGCACGCC GCCGCCGGTG GTGTCGGCAT GGCCGCCGTA

37021  CACCTCGCCC ACCACTTCGG CGCCACCGTC CTCGCCACCG CCCACCCGGC CAAACACCAC

37081  AGCCTGGAAC AGCTCGGGGT GCCCACGGAA CGACGCGCCT CCAGCCGCGA CCTCGCCTAC

37141  GCCCGCACCT TCCCGACCGC CGACATCGTC CTCAACTCCC TCACCGGCGA ACACATCGAT

37201  GCCTCCCTCG GCTCCTGGCC CCCCGGCGGC CGTTTCATCG AGATGGGACG CACCGACATC

37261  CGGGACGTGG ACGAGGTGCG CGCGTCCCAT CCGGACCGGA CATATCGCGC GTTCGACCTG

27321  GGCGCGGACG CTGGGCCGGA CCGCATCCAG GAGCTGCTGG CCGAGCTGGT GGACCTGTTC

37381  GAGCAGGGCC TGATCCCTCC GTTGCCCACC CGGCCGTGGG AGATCACCCG CGCCCCCGAC

37441  GCATTCCGCT GGATGAGCCA GGGCCGCCAC ACCGGCAAGA TCGTGCTCAC CCTCCCCCGC

37501  ATCCCCGACC CCGAGGCCAC CGTACTGATC ACCGGCGGCA CCGGCACCCT CGGCACCGCC

37561  ATCACCCGCC ACCTCGTCAC CCACCACGGC GTACGCAACC TGGTCCTCGC CAGCCGCCAG

37621  GGGCCGAACG CCCTCGGCGC GGCCGACCTC CACGACGAAC TGACCGCACT GGGCGCACAG

37681  GTACGCATCA CCGCCTGCGA TATCGCCGAC CGCGGCCAAC TCGCCGCGCT CCTCGCCGAC

37741  ATCCCGTCCG ACCACCCCCT CACCGGCATC GTGCACACCG CCGGCGCCCT GGCCGACGGC

37801  ACCCTCACCA CACTCGACCC CGACCGCATC GACACCGTCT TCCGCCCCAA GGTCGACGCC

37861  GTCACCCACC TGCACGACCT CACCCGCGAC CAGGACCTGG CCCTCTTCGC CGTGTACTCC
```

```
37921  TCCGCCGCCG GAATCCTCGG GAACGCGGGT CAGGCCAACT ACGCCGCCGC CAATACCTTC
37981  CTCGACGCCT TCGTACAGCG GCGGCGCGCG GCGGGGCTCG CCGGGCTGTC ACTGGCCTGG
38041  GGCCTGTGGG CGGAGACCAG CGACCTGTCG GCCGCGCTGA TCACGGCCAA CCGGGATCGC
38101  ACCCAACACG GTGTCGTCCG CCCGATGGCC ACCGAGCACG CCCTGAGCCT CTTCGACTCC
38161  GCGCTCGGCC TGGGGTTGTC CCTGGTGGTA CCGGCGAAGC TGGACCCGGG CGCGCACGAG
38221  TCCGCCGCGG GCGCTGTGCC GCCGCTGCTC ACCGGCCTCC TCCGGCCGAC CCGGCGCACC
38281  TTGCGGTCCA CGGCGGGCCA ATCCGGCGAA GGCGGTCTCA CGGCCCGGCT GGCGGCGCTG
38341  TCCGAGGCCG ACCAGCACCG GCTGCTGCTG GACCTGGTAC GGGACCATAC TGCGACCGTA
38401  CTCGGGCACG CCGGGAAGGA CGCCGTGGAC GCCAGGCGCG CGTTCAGCGA GATCGGGGTC
38461  GACTCGCTCA TCGCGGTGGA ACTGCGCAAC CGGCTCGCCG GCGCGACCGG GCTGCGCCTG
38521  CCCGCGACGG TCGTGTTCGA CTACGCGACA CCGGAGGCGA TGGCCGGGCA TCTGCGGTCC
38581  GTGGTGGCCG GAGACACGGC CGCCCCTGCC TCCCCGTCGA CGTCGGCGGT GGCGCCCGCT
38641  TCCGCGGTGG CCCCGGCGGA CGACCCGGTG GCCATCGTGT CGATGAACTG CCGGCTGCCC
38701  GGCAAGGTCA CCGGCCCCGG GGAGCTGTGG GATCTGGTGT CCCAGGGCCG GGACGCGATC
38761  GGCCCGTTCC CCACGGACCG CGGCTGGGAC GTGGAGACGC TGTTCGACCT CGATCCGGAC
38821  GCCGTGGGCA AGTCCTACGT ACGCGAGGGC GGTTTCCTCA CCGGCGCCGG CGACTTCGAC
38881  GCCGAGTTCT TCGGCATCTC GCCGCGTGAG GCGCTGGCGA TGGATCCGCA GCAGCGACTG
38941  CTCGCCGAGA CCTCATGGGA GCTGTTCGAG CGGGCGGGCA TCGACCCGGT GTCCGTGCGC
39001  GGACAGGCCA TCGGGGTGTT CGCCGGGGTC ATCGACCAGG GATACATCGC CCACTCCGAG
39061  GCCCCTCCGC CGGAGTTGGA GGGCTACCTG ATGACGGGCA GCACCACGAG TGTGGCCTCC
39121  GGCCGAGTGG CCTACCTGCT GGGCCTCGAA GGCCCCGCGG TGACGGTGGA CACGGCGTGC
39181  TCGTCGTCGC TGGTGGCGCT GCATCTGGCC GTGCAGGCGC TGCGGGCGGG CGAGTGCTCG
39241  ATGGCCATCA CCGGTGGCGT GACGGTGATC GCCAAGCCCG GCGGTTTCAT CAGCTTCTCC
39301  CGCCAGCGCG GGCTCGCGCC GGATGGCCGC AGCAAGTCCT TCAGCGAGGG CGCCGACGGC
39361  ACCAGCTTCA GCGAGGGCAT CGGTCTGGTG TTGCTGGAAC GGCTCTCCGA CGCCCGCCGC
39421  AACGGCCACG AGGTCCTGGC CGTGATCCGT GGCACGGCGG TGAACCAGGA CGGCGCGAGC
39481  AACGGCCTCA CCGCGCCCAA CGGACCCTCC CAGCAGCGAG TGATACGGCA GGCGCTGGCG
39541  AACGCCGGGC TGACGGTGGC CGACGTGGAC GCGGTCGAGG CCCACGGCAC CGGCACCGCC
39601  CTCGGCGACC CCATCGAGGC CCAGGCACTC CTGGCCACCT ACGGCCAGGA CCGGCCGGGG
39661  GACGAACCGC TGTGGCTCGG TTCGCTGAAG TCCAACATCG GCACACCCA GGCCGCCGCC
39721  GCCATCGCGG GCCTCATCAA GATGGTGCTG GCGATACGGC AGGGCACGCT TCCGCGGTCC
39781  CTGCACGCCG GCGAACCCAC CACCAAGGTC GACTGGACGT CGGGCGCGGT GTCGCTGCTG
39841  TCCGAGGCCC GGCCCTGGCC GGAGACGGGA CACCCCCGCC GCGCCGGAAT CTCCTCCTTC
39901  GGCATCAGCG GGACGAACGC ACACGTGATC CTCGAGCAGG GCCGGAGGT GGCTGTGCCC
39961  GCAACGGAGG CGCGCGACGC GGGCGCTCCT GGGCTGGTGG CCACGGGCGG CGTGGTGCCG
40021  TGGGCGCTGT CCGCCAAGAG CCCTGCGGCG CTGCGGGCCC AGGCCGAGCG TCTGGTCAGC
40081  CACCTGGAAT CCGGGACGC TCCGCGTGCG GTGGACGTGG GCTGGACGCT GGCCACCACC
40141  CGAGCGGCGT TGGAACACCG CGCGGTCATC CTCGCCACCG ACACCGAAGA CGGCATCGCC
40201  ACCGCCCGCG CCCTGGCGGA GGGACGGCCT GACCCGCTCC TGGTCACCGG GCAGACCGGG
40261  ACGGACGGCA AGACCGTGTT CGTCTTCCCT GGTCAGGGGG CCCAGTGGGT GGGCATGGGA
```

```
                                  -continued
40321  GCCCAACTCC TCAACACCTC ACCCGTCTTC GCGGCTCGCT TGAACGAATG TGCCGAGGCC

40381  CTGGCCCCGT ATACCGACTG GTCGCTGATG GACGTCATCA CCGGCGCTCC CGCCGCCCCT

40441  TCGCTCGAGC GTGTCGATGT CGTACAGCCC GCCACCTTCG CCGTCGTCGT CTCCCTCGCC

40501  GCACTCTGGC AATCCGTGGG CATCCACCCC GACGCCGTCA TCGGCCACTC CCAAGGCGAA

40561  ATCGCCGCCG CCTGCGTCGC CGGACACCTC ACCCTCACCA ACGCCGCCAA AATCGTCACC

40621  CTCCGCAGCC AGACCATCGC CCACCACCTC GCCGGACACG GCGGCATGAT GTCCGTCCTC

40681  GCCTCCCGGG AACAGGTCGA GGAAGCCCTC ACCCCGTGGC ACGGCAAACT CTGGATCGCC

40741  GCACACAACA GCCCCAACGC CACCGTCATC GCAGGCGACA CCGACGCCCT GCACCAACTC

40801  CACACCCACT ACACCGACCA GGGCATCACG GCCCGCGTCA TCCCCGTCGA CTACGCCTCC

40861  CACACCGGAC ACGTCGACAC CATCAAAAAC CAACTCCACC AGACCCTGGC CGACACCACG

40921  ACCGAGCCCG GCACCATCCC CTGGCTCTCC ACCGTCACCG GACAGTGGAT CGAACCCGAC

40981  ACCGTCGACA GCGGCTACTG GTACCGCAAC CTCCGCCAAA CCGTGCAGTT CCACACCGCC

41041  ATCACCGCCC TCGCCCATGA GGGCTACCGC ACCTTCATCG AAATCAGCCC CCACCCCGTC

41101  CTCACCACCG CCATCCAAGA AACCCTCGAA GCCAACGACA CCCCCAACAC CACCATCACC

41161  GGCACCCTCC GCCGCGACGA CGACACCCCC ACCCGCTTCC TCACCCACCT CGCCCACCTC

41221  ACCACTCACG GCCACACCCC CGACTGGACC GCCCTCTACT CCGCCACCCA CCCCCGCCCC

41281  ACGCCCCTCC CCACCTACGC CTTCCAACAC CACCACTACT GGCTCACGCC GTCCGAGGTA

41341  CCGGAGGCGG TGGCCGACGG TGTGTTCTGG GACGCCGTGG AGCCGGGCGA CCTCGCCTCC

41401  CTGGCCGATT CACTCGGCGT CGACGAGAAG ACGCTGGAGC CCGTGCTGCC GGGGTTGACG

41461  TCGTGGCGGC GCCGCAACCA GGACCAGTCC ACCGTGGACA CCTGGTCGTA TCGCATCGCC

41521  TGGGATCCGG TGGCGACCGG AGAGGCGCCC GTACTGCCGG GAGCGTGGCT GGTGGCCGTG

41581  GCCTCACCGC AGGCGAGCGA CGCCGCGGTG ACGGACGTGG TGGCCGCACT GGCCGCGCAC

41641  GGTGCCGATC CCGTGGTGGT CGAGGTCGAC ACGGTGGAAC AGGCGGAGGT GACCGCGCGC

41701  CTGCGGGAGC GGATATCCGA TTCCGATGAC GAGTACGCCG GAGTGGTGTC CCTGCTGGCG

41761  TGGGACGAGC GGAGCTACGA ACCCGGCACG CTCTCCCGGG GCGTGGCGGC CACGGTGGCG

41821  CTGATACAGG CCGTGGAGGA GATCGGGCTC GCCGCTCCCC TGTGGTGCCT GACGCGTGGC

41881  GCGGTCGCCG TGCGTGAGCC CTCCGAGGTG ACCAGCGAGT TCCAGCCGCT GGCCTGGGGA

41941  ATGGGCGTGG TGCAGGGGCT GGATCAGCCG TCCACCTGGG GCGGGATCGT GGATCTGCCG

42001  CGGACGCCGG ACGAGACGGC CCTTGTCCGG TTGTGCTCGG TGCTTGCCGG AGTGGACGCG

42061  GAGGACCAGG TCGCGGTGCG CGCGTCGGGG GTGTTCGCCC GGCGGATGCG GCGCGAACCG

42121  GTGACGTCCG CACCGGCGTG GCAGCCACGG GACACGGTGC TGATCACCGG TGGCACCGGC

42181  GGGCTCGGTT CGTACGTGGG CCGTTGGGCC GCGGGTCACG GCGCCCGGCG TGTGGTGCTG

42241  CTCAGCCGTC AGGGTGCGCA GGCGCCGGGC GCGGCGGAGC TGGAGGCCGA GCTGAGCGCA

42301  CTGGGCGCGG ATGTGACCAT CGCGGCGTGT GATGTGACCG ACCGGGACCA GCTAGCGGCC

42361  GTCCTGGCGG AGATCCCGGA TGACGCGCCA CTGTCGGGCG TGGTCCACGC CGCGGGGCTG

42421  GCGCTGCCGG AGAAGCCGCT GTCGAAGATG ACACTCGCCG AGTTCGCCGA CATCGGCCAG

42481  GCGAAGATCG CCGGTGCGCG GCATCTCGAC GACCTGTTGG GGGAGCGGGA GTTGGACGCC

42541  TTCGTCCTGT TCTCGTCCGG AGCGGCGGCC TGGGGCAGCG GCGGCCAGAG CGCCTACGCC

42601  GCCGGCAACG CCTACCTCGA CGGGCTGGCG CAGCGCCGCC GCGCACGGGG GCTGGCGGCC

42661  ACGTCGGTGG CGTGGGGCGC CTGGGGCGGT GGCCTTGGCA CGATCGACGA GATGATGGGC
```

```
42721 GCGCAGTGGC GCCGTACAGG TCTGATGACC ATGGACCCGC GGCTGGCGGC GCTGGCGATG

42781 GCACACACCG TGGGCAGCGG CACCGCCCAC GGTGTGGTGG CCGACATCGA CTGGGAACGG

42841 TTCGCCCCCG GCTACACCAT GGCCCGGTTC CGGCCCCTGC TGCGGGGACT GCCCGATGTC

42901 ATCGACCTGC TGACCGAGGA CGCACCCGAG GACAGCGCGG GACAGACGGA GCTGATCGCA

42961 CGGCTGGCCG GACTGAGCCC CGAGGATCAG GAGCGGCTGC TCACCGAGCT GGTGCAGGCC

43021 GAGGCCGCGG CCGTACTCGG ACACGTGAGC GCCGACGCCA CCGGGGACCG TCCGTTCAGC

43081 GAGATCGGAT TCGACTCGCT GACGGCGGTG GAGCTGCGCA ACCGCCTCAA TGCCAGCACG

43141 GGGCTGAGGC TGCCCGCGAC GATGGTGTTC GACCACCCGC GGCCCAGTGT GCTGGCACGC

43201 CGTATCCGCA CCGAACTCGG CCATACCGAC ACCTCGTCGG TGGACTCGGT GCTGGCCGAG

43261 CTGGAGCGGC TGGAAGCACA TTTGGCGGCG CTGCCGAAGG AGAAGATCGA ACGCGCCCGG

43321 ATCACCTCGC GGCTCCAGCG GATGACCACC AAGGTCGCCG AGATCGAGGC CGTCGGCACG

43381 GGCGGCGACA CCGTCACCGA ACGACTCGAC ACGGCGAACG CCGACGACGT GTTCGCCTTC

43441 ATCGACCAGG AGTTCGGCGT GGACTGATTC CCCGTCTCGT CTCCGCTCAC CGATTTCACC

43501 CACGAGGCTC TTGGCGAGGT CCAGATGGCG AATGACGAAA AGCTCCTCAA CTACCTCAAG

43561 CGGGTTACCG CCGACCTGCA CCAGACGCGG GAACGGTTGC GCAAGGCCGA GGCGGCGACG

43621 GAGGAGCCGA TCGCCATCGT CGGCATGGGC TGCCGCTTCC CGGGCGGCGT GACCACCCCG

43681 GACGGGCTGT GGGATCTGGT GGCCGACGGC CGGGACGCGA TCGCCGGGTT TCCGGAGGAC

43741 CGCGGCTGGA ACCTGGAGAA CCTCTTCGAC GCCGACCCCG ACTCCGTCGG CACCTCCTAT

43801 GTGCGCGAGG GCGGCTTCCT CACCGACGCG GCGGAGTTCG ACGCCGAGTT CTTCGGCATC

43861 TCCCCGCGTG AGGCGCTGGC CACCGATCCG CACCACCGGC TGCTGCTGGA GACCGCGTGG

43921 GAGACCCTCG AGCACGCGGG AATCGACCCG AGTTCGCTGG AGGACAGCGA CGTCGGCGTG

43981 TTCACCGGCC TGGCCAACGG CGACTACGCG CTGACCGTGG ACCAGGTGCC GGAAGGCTTC

44041 GAGGGGTATC TGGGCCTTGG TGGCGCGGGC AGCATCGCGT CCGGCCGTAT CTCGTACTCG

44101 CTCGGTCTGC TCGGCCCGGC GGTCACTCTG GACACCGGGT GCTCCTCGTC CCTCGTGGCG

44161 ATGCACTTGG CCAGTTATGC GCTCCGGTCC GGGGAGTGCT CCATGGCGCT CGCCGGTGGG

44221 GTGATGGTGA TGGCGACCCC TGGCGGCTTC GTCGGATTCT CCCGGCAGCG GGGGCTGGCG

44281 CGCGACGGGC GCTGCAAGTC CTTCGGTGAG GGCGCCGACG GCACCAACTG GTCCGAGGGC

44341 GTCGGTCTTG TGCTGCTGGA GCGGCTGTCC GAAGCCCACC GCAACGGCCA CCCGGTACTC

44401 GCGGTCATCC GTGGCACGGC CGTCAACCAG GACGGCGCCT CCAACGGCAT CACCGCGCCC

4A461 AACGGGCCGT CCCAGGAACG GGTGATCCGG CAGGCGCTGG CGAACGCCGG ACTGTCGCTG

44521 GCCGATGTGG ACGCGGTCGA AGCCCACGGC ACCGGGAGGA GTCTCGGCGA CCCGATCGAG

44581 GCCCAGGCAC TCCTGGCCAC CTACGGTCAG AACCGCCCGG AGGATCAGCC GCTGTGGCTG

44641 GGCTCCATCA AGTCCAACAT CGGCCATACC CAGGCCGCCG CGGGTGTCGC GGGCGTCATC

44701 AAAATGGTCC AGGCCATGCG GCACGGCGTA CTGCCCAAAA CCCTCCACGC CGACGAGCCC

44761 ACCAGCAAGG TCGACTGGAC GTCAGGTGCG GTGTCCCTGC TGTCCGAGGC CCGGCCCTGG

44821 CCGGAGACGG GACACCCCCG CCGCGCCGGA ATCTCCTCCT TCGGCGTCAG CGGGACGAAC

44881 GCACACGTGG TCCTGGAACA GGCACCCCTG GAAGCGGCTG CACCCGAAGT AGACGTAGAC

44941 GAGGCGGGCG CTCCTGGACT GGTGGCCACG GGCGGCGTGG TGCCGTGGGT GCTCTCCGGT

45001 AAGACTCCTG CGGCGCTGCG GGCTCAGGCG GAGCGTCTGG TCAGCCACCT GGAATCCGGG

45061 GACGCTCCGA ATGCGGTGGA CGTGGGCTGG TCACTGGCCA CCACCCGGGC GGCGTTGGAG
```

-continued

```
45121  CACCGCGCGG TCATCCTGGC CACGGACACC GAAGGAGGCA TGGCGACGGC GCGGGCTCTG
45181  GCGGAGGGAC GGCCTGACCC GCTCCTGGTC ACCGGACAGA CCGGAACAGA CGGCAAAACC
45241  GTGTTCATCT TCCCCGGCCA AGGCGCCCAA TGGGTGGGCA TGGGAGCCCA ACTCCTCAAC
45301  ACCTCACCCG TCTTCGCCGC CCGCCTGCGC GAGTGCGCCG ATGCTCTAGC GCCGTATACC
45361  GACTGGTCGC TCATCGACGT CATCACCGGC ACGCCCGACG CCCCATCGCT CGACCGTGTC
45421  GACGTCGTAC AGCCCGCCAC CTTCGCCGTC GTCGTCTCCC TCGCCGCACT CTGGCAATCC
45481  GTGGGCATCC ACCCCGACGC CGTCATCGGC CACTCCCAAG GCGAAATCGC CGCCGCCTGC
45541  GTCGCCGGAC ACCTCACCCT CACCAACGCC GCCAAAATCG TCACCCTCCG CAGCCAGACC
45601  ATCGCCCACC ACCTCGCCGG ACACGGCGGC ATGATGTCCC TCGCCACCCC CGCCGACACC
45661  ATCGACCTCA CCAACTGGCA CGGCAAACTC TGGATCGCCG CACACAACAG CCCCAACGCC
45721  ACCGTCATCG CAGGCGACAC CGACGCCCTG CACCAACTCC ACACCCACTA CACCGACCAG
45781  GGCACCAGAG CCCGCATCAT CCCCGTCGAC TACGCCTCCC ACACCGGACA CGTCGACACC
45841  ATCAAAAACC AGCTACAAGA CGTACTCGAC GGCGTCACCC TCGAGCCCGG CACCATCCCC
45901  TGGCTCTCCA CGGTCGACGG ACAGTGGATC GAGCCCAGCA CGGTCGGCGA CAGCTACTGG
45961  TACCGCAACC TCCGCCAGAC CGTGCAATTC GAGCACACCA TCACCACCCT CGCCGACCAG
46021  GCCTACCGCA CCTTCATAGA AATCAGCCCC CATCCCGTCC TCACCACCTC CATCCAAGAA
46081  ACCCTCGAAG CCAACGACAC CTCCAGCACC ATCGTCACCG CCACCCTCCG CCGCGACGAC
46141  GACACCCCCA CCCGCCTCCT CACCAACCTC GCCCACCTCA CCACCAACGG AACACCAGTC
46201  AACTGGACCA CCCTCTTCAC AGGCACCCAA CCCACCCGCA TCCCCCTCCC CACCTACCCC
46261  TTCCAACACC ACCACTACTG GCTCCCCCGC AACACCAACG CAGGCGACAT CGCCTCGGCC
46321  GGTCTCCACG ACCCCGGGCA CCCGCTGCTC ACCGCCGCCG TCCACCTCCC CGACACCGGT
46381  GGCACCGTTC TCACCGGGCG CCTCTCCCTG ACCACCCACC CCTGGCTGGC CGACCACACC
46441  GTGTCCGGCG CCGTCCTCCT CCCCGGCGCC GCGATGGCCG AACTCGCCAT CCGCGCCGGA
46501  GACGAGACCG ACACCCCCAC CCTGGAAGAG CTGGTCATCG AGCAGCCACT GGCGCTGCCG
46561  GACAGTGGCT TCCTGGACAT CCGGGTGGTC GTGGGCGGCC CTGACGAGTC CGGGCGTCGG
46621  GACGTACGCA TCTATTCCCG CGCCGAAGAA GAAACCGCGC AGTGGACGGA GCACGCCACC
46681  GGCACGCTGG CTCAGGACAC CACGGCTCCT CCGTCGCCCG CCGTCGCCGA ATGGCCACCC
46741  GCCGGTGCCG AGCCGGTGGC CGTCGAGGGG CTGTACGAGC AGATGGCCGA GGGGGGCTAC
46801  GACTACGGGC CGACCTTCCA GGGCCTGAAG GCGGTATGGA CCCGCGACGG CGAAGTGGGC
46861  GAGGTGTTCG CGGAGGCCGC GCTGCCGGAG GAGCAGACGG AGGCCGCCGG CCGGTTCGGC
46921  ATCCACCCGG CACTGCTGGA CGCCGCATTG CACGCGAGCA ACTACTGCCT GCCCGGGGAA
46981  CCCGGTAGCC GCATGCTGCT GCCGTTCGCG TGGAACGGCA TACGCCTGCA CGCCACCCGT
47041  GCCACGTCGG TGCGCGTGCA CGCCCGTTAC ACCGAGGACG GCGGGCTCTC CGTGGTCCTG
47101  GTCGACGCAG CCGGCGGGCT GGTCGCGTCG ATCGGTTCGC TGGTTCTGCG GGAGGTCGAC
47161  GCGGCGCAGC TCGAAGCGCT GACCTCCACG TCGGTGAACG ACTCACTCTG GACGGTCACT
47221  TGGACCGAAC ACACCGCCAC CACGGACGAG ATCCGGTGGG CACCGTCGG GACGTCTCA
47281  CCCGTCCTCG CCGCCGCCGA AGCCCCGGCC TTCGCCGATG TCACAGAGAT CGCCACGGGG
47341  CCCGCCATCG GGATGGGCAC GGAGATCGCC GGGGCCGAGG AGCGGCCCGC GCTGGTCGTC
47401  GCCGACACCA CCGTATGGGA GTCCCGGGAC GCCGACCCCA TCACGCGGGC GCGGGAGCTG
47461  GCCACGCGGG CACTGGACCT GTTGCAGCGG TGGGTGACCC TGCCTGACCT GTCGGAAACA
```

-continued

```
47521  CGGCTGGCGG TCCTCACGCG CGGTGCGATG GCCGTACACG ACTCGTCCGA GGTCACCGAC
47581  CCTGCCGCGG CGGCGATCTG GGGTCTCGTC CGCTCGGCCC AGTCCGAACA CCCCGGCCGC
47641  GTCCACCTCA TCGACACCGA CGGCCACTCG GACCACGCAC TGCGCAGCGC ACTGCCCACC
47701  GCACTCGCCA CCGACCAGCC CCAACTGGCC CTCCGCGACA ACACGCTCTG GGCGCCCCGG
47761  CTCACCGCCG CGGCACCCGT CGGCACACCG GCCCAGCCGC TCCCCCTCGA CCCCGAGGGC
47821  ACCGTTCTCA TCACCGGCGG CACCGGCACC CTGGGCGCCC TCACCGCCCG CCACCTCATC
47881  ACCCACCACG GCGCCCGGCA CCTGCTGCTC ACCAGCCGCC AGGGTCCCTA CGCCCCCGGC
47941  GCCACGGACC TCACCACCGA ACTCACCGAA CTCGGCGCCA CCGTCCACAT CACCGCCTGC
48001  GACACCGCCG ACCGCGACCA ACTCGCCGCC CTCCTCGCCA ACATCCCGGC CGCCCACCCC
48061  CTCACCGCCG TCGTCCACAC CGCCGGAACC CTCGACGACG CCCTGCTCAC CGACCTCACC
48121  CCGCAGCGCC TCGACACCGT CTTCCGCCCC AAGGTCGACG CCCTCACCCA CCTCCACGAC
48181  CTCACCCGCG ACCACGACCT GACCGCCTTC GTCATCTACT CCTCCGCCAC CGGCACCCTC
48241  GGCACCCCCG GCCAGGCCAA CTACGCCGCC GCCAACACCT ACGCCGACGC CCTCGCCCAC
48301  CAGCGCCACG CCACCGGACT CCCCGCCACC TCCCTCGCCT GGGGCCTATG GGAAACCACC
48361  AGCGCCCTCA CCGCCACCAT GAACACCGAG GACCGCCGGC GCACCCACCG CGGCGGCGTG
48421  GCCCCCCTCA CCGACGACGA GGGGCTCGTC CTCCTCGACA CGGCCCTCAC CGCCACCCAC
48481  CACCCCCACC TCGTCCCGAT CAAGATCAGC CCGGCCTCCC TGCGAGCCGA TGACACGGCG
48541  CGGCCCGTTC CCCCGCTCCT CCGCCACCTC GTACGACGCC CCACGCGCCG CACGGCCCAC
48601  ACACCGGCCC CAGCGGACAC CCTGTCGCTC ACCCGACGGC TCGCCGCCCT CGACCACGGC
48661  GAACGGCTAC GGCACCTCAT CGAGCTCGTC CGCACCGAGG CGGCAGCCGT GCTCGGACAC
48721  CCGACGATCG ACAGCATCGG ACCGGACCAG CCCTTCCGGG ACGCCGGGTT CGACTCGCTG
48781  ACGGCGGTGG AACTGCGCAA CCGCCTCAAT ACGGCCACGG GACTGCGGCT CCCCGCGACC
48841  GTGGTGTTCG ACTACCCGAC CTCGGCGATC ACCGCCGGGT ATCTGCGGGA CGAGCTGTTC
48901  GGCTCGACGG AGGCGGCTCC GGCCGCCGTC GCCGGGCGGG GGGCCGACGC GGACGACCCC
48961  GTGGTCGTCG TCGGCATGGC CTGCCGACTC CCCGGACGGG TGACCGACCC GGACGGGCTG
49021  TGGCGGCTGG TGGCCGACGG GGAGGACGGC ATCGGGGCGT TCCCCACCGA CCGCGGTTGG
49081  GATCTGGACA CGCTGTTCGA CCCCGACCCG GACCGGGTGG GCGCGACCTA CGTCCGCGAG
49141  GGCGGGTTCG TGGCGGGTGC CACCGAGTTC GACGCGGACT TCTTCGGCAT CTCCCCGCGT
49201  GAGGCCGTGG CGATGGACCC GCAGCAACGG CTGTTGCTGG AGACCGCGTG GGAGACCTTC
49261  GAGCAGGCCG GTATCGCCCC GCGGTCGGTG CAGGGCACCG ACACCGGCGT GTTCGCCGGG
49321  GTCATCTACC ACGACTACGG GACGAACGCC GGTGAGCTGC CCGAGGGCTC GGAGACCTAT
49381  CTGAGCACGG GCAAATCGGG GAGCGTGGTG TCCGGGCGGG TCGCCTACGC ACTGGGCCTG
49441  ACCGGTCCCG CGGTGACGGT CGACACGGCC TGCTCCTCCT CGCTGGTGGC CATCCACTGG
49501  GCGGCCAAGG CGGTGCGGGA GGGCGAGTGC TCGATGGCCC TGGCCGGGGG CGTGACGGTG
49561  ATGTCGACCC CGGAGGGGTT CGTGAGCTTC TCGCACCAGC GTGGGCTCGC CCCCGATGGC
49621  CGCAGCAAGT CCTTCGGCGA GGGCGCCGAC GGCACCACCT TCAGCGAGGG TGTCGGGCTC
49681  GTGCTGCTGG AACGGCTCTC CGAGGCCCGG CGCAACGGTC ACGAGGTGCT GGCCGTGATC
49741  GCCGGTACGG CGGTCAACCA GGACGGCGCC AGCAACGGCC TCACCGCCCC CAACGGACCC
49801  TCCCAGCAAC GGGTGATCCG GCAAGCACTC GCGAACGCCG GGCTGTCGGC CACCGACATC
49861  GACGCCGTCG AAGCCCACGG CACCGGCACC GCCCTCGGCG ACCCCATCGA AGCCCAGGCA
```

-continued

```
49921  CTCCTGGCCA CCTACGGCCA GAACCGCCCC GCCGACCAGC CCCTCTGGCT GGGCTCGCTG
49981  AAGTCCAACA TCGGCCACAC CCAGGCCGCC GCGGGCATCG CGGGCCTCAT CAAGATGATC
50041  CAGGCCATGC GGCACGGCAT GCTGCCCAGG ACACTCCACG CCGACGAGCC CACCACCAAG
50101  GTCGACTGGA CATCGGGCGC GGTGTCCCTG CTGACGGAGG CCCGCCCCTG GCCGGAGACC
50161  GGCCACCCAC GCCGTGCCGG GATCTCCTCC TTCGGCGTCA GCGGCACCAA CGCCCATCTC
50221  ATCCTCGAAC AGGCCCCGGA AGACGCGGCC ACCGCACCAG AAATCACGGA ACCGGAGGCT
50281  CCCGGGCTGG TGGCCACGGG CGGCGCGGTG CCGTGGGTGC TGTCCGCCAA GAGCCCCACG
50341  GCCCTGCGGG CGCAGGCCGA ACGCCTGATC GCCCACCTTC ACCCCCACCC CGAGATCGAC
50401  CCGGTGGACA TGGGCTGGTC ACTGGCCACC AGCCGCGCCG CCCTGGAACA CCGCGCGGTC
50461  GTCCTCGCCA CCGATCTCGA CCAGGCGACC GCCGCCCTCA CCGCTCTCAG CGAGGGGCAG
50521  CCGCACCCCG GCCTGGTCAC CGGGGAGACG GGCAGCGACG GCAAGACCGT CTTCGTCTTC
50581  CCCGGCCAGG GCGCCCAATG GCAAGGCATG GGAGCCCAAC TCCTCAACAC CTCACCCCTC
50641  TTCGCCACCC GCCTCCACGA ATGCGCCGAC GCCCTCGCCC CGTATACCGA CTGGTCGCTC
50701  ATCGACGTCA TCACCGGCGC ACCCGGCGCG CCCAGCCTCG ACCGTGTCGA TGTCCTGCAG
50761  CCCACCACCT TCGCCATCAT GGTCTCCCTC GCCGCACTCT GGCAGGCCAA CGGCATCCAC
50821  CCCGACGCCG TCATCGGCCA CTCCCAAGGC GAAATCGCCG CCGCCCACAT CGCCGGACAC
50881  CTCACCCTCA CCAACGCCGC CAAAATCGTC ACCCTCCGCA GCCAGACCAT CGCCCACCAC
50941  CTCACCGGAC ACGGCGCCAT GATGTCCGTC CTCGCCCCCC ACACCTGGGT CCAAGAAGCA
51001  CTCACCCCCT GGCACGAACA CCTGTGGATC GCCGCCGTCA ACGGCCCCGC CTCCGTATCC
51061  GTCTCCGGAG ACCCCGACGC ACTCGCCGAA TTCGGTGTCA CCCTCTCCAA GGCGAAGGTC
51121  TACCGCTGGC AGTTGCCCGG GGTGGACTTC GCCGGACACT CCGGACACGT CGACACCATC
51181  AAAGACCAGC TACACCACGT ACTCGACGGC GTCACCGCCT CCCCCGGCAA CATCGCCTGG
51241  ATGTCCACCG TCGACGCCAA CTGGACCAAC CCCACACACA TCGACGCCCA CTACTGGTAC
51301  CGCAACCTCC GCGACACCGT CCGCTTCGAA GAAGCCACCC GAGCCCTCCT CACCCACGGC
51361  CACCGCGTCT TCATCGAAAT CAGCACCCAC CCCGTCCTGA CCACCGCCAT CCAGGACACC
51421  ACCGAAACCC TCCCCGAGGT CCGGGCCACC ATCACCGGAA CGCTGCGCCG CGACGACGGC
51481  GGCCCCGACC GCGTTCTCGC GGGGCTGGGA GGGCTGTTCG CGGCCGGGGT GCCGGTGGAC
51541  TGGGGCGCCC TGTTCGCCAG TACCGGGGCC CGTCGGGTGC CGCTGCCCAC GTACGdCTTC
51601  CAGCACCGGC ACTACTGGCT GGAGCCCGCC AGGACACCGA CGCGGGCCGA GAGCGCCGAC
51661  GGCTCCCTGT GGGCGGCCAT CGAGGACGGA GACGCGCAGT CTCTCGCGCG GGATCTTGAT
51721  GTGGACGCGG CGGCCCTCGG CACGGTGCTG CCCGCGCTCG CCTCATGGCG TCGGCGCAGC
51781  CGGGAGGACT CCCTCACGGA CGCATGGCGG TACCGGATCG GCTGGACCCG GGTGGCCACG
51841  GCCGACCCGC AGTTGTCGGG CCGGTGGCTG GTGCTGGTCC CGGCCGTGCC GGCGGGCTCG
51901  GCGCGGGTCC GTGCGGTGCT GGACGGGCTG GCCGCGCGGG GCGCCGAGGT GGTGGCCGCC
51961  GAGGTCTCCG AAACCGGCCG GGAGGCACTG GGCGACCAGG TCAAGTCGGC GGACGGCGGT
52021  GCCGGGGTGG TGTCCCTGCT CTCGTGGGAC GACCGCGCCG ACACCGAGTA CGGCACCGTG
52081  TCCACGGGCA CCGCCGCGAC GCTCGCGGTG GCACAGGCGT TGCGGGACCA CGGCGTCACC
52141  GCTCCGCTGT GGTGCGTCAC CAGTGGCGGG GTCGCGGTGG CCGGTGAGGC GGCCGACCCG
52201  GTGCAGTCCG CGGTGTGGGG ATTCGGCGCC GTACTCGGGC TCGACCACCC GGACACCTTC
52261  GGCGGCCTGA TCGATCTGCC GGCCGAAGGG GAGGGTGACG ACGAGGCGTT GCCGGACGGG
```

-continued

```
52321  CTGTTCGCGG CGCTGTCGTC CCCCGAGGGG GAGGACCAGC TCGCGGTGCG CGCCGACGGG
52381  CTGTTCGCAC GCCGGATGGT GCGCGACCGG GACGGCTCCG GCAGCCCCTG GAAGCCGCGC
52441  GGCACCGTGC TGGTCACGGG CGGCACCGGC GGGCTCGGTT CGCATGTGGC GCGCTGGCTC
52501  GCCACGAGCG GGGCGGACCA TGTGGTGCTG CTCAGCAGGC AGGGTGGTGA CGCGCCGGGC
52561  GCGGCCGAAC TGGTGGCGGA CCTGGCGGGG GTGGAGGTCA CGCTCGCCGC GTGTGATGTG
52621  ACCGACCGGG ACGCCGTGGC CGCGGTGCTG GCCGAAGCGG AGCGGACCCA TCCGCTGACC
52681  GCGGTGGTGC ACACCGCCGG TGCCGGGCTG CCCTCGGCTC CGGTCACCGA GGTGACCACC
52741  GAGGAGTTCG CCGCCGTCAC GGGGGCGAAG GTGCGCGGCG CGCTGGTGCT GGACGAGCTC
52801  GTCGGCGACC GGGAGCTCGA CGCGTTCGTG CTGTTCTCCT CCGGCGCCGG TGTCTGGGGC
52861  AGCGGCGGGC AGGCCCCGTA CGCGGCGGGC AACGCCTTCC TGGACGGGCT GGCGGCCCGG
52921  CGGCGGGCAC ACGGGCTCGC GGCCACGGCG GTGGCGTGGG GCGGCTGGGG CGGCGGGCTC
52981  GGCATGATCG ACGCCGACGG CGGCGACCAG TGGCGCCGTA TCGGCATCCT GCCGATGGAT
53041  CCGGCGCCCG CGCTGCGTGC GCTGGCGCGG GCCGTTGGGG GTGGTCTGCC GAATGTGATC
53101  GTCGCGGATG TCGACTGGGC GCGGTTCGTG CCGGGCTACA CGATGGCCCG GGAGCGGCCG
53161  CTGCTGCGGC AGTTGCCCGA GGTCGCCGAG ATCCTGGCGG CGGACACGCA GGGCGGGGGC
53221  GCATCGCGGC GGGAGGTGCT CCTGGGCAGC CTGGCCGAGC TGACCGGCCC GGAGCAGGAG
53281  GTGTTCCTTA CCGACCTGGT GCGGCGTGAG GCGGCGGCCG TGCTCGGGCA TGCGGACGGG
53341  GACGCGGTGG AGCCGGAGCG TGCGTTCAAG GACACCGGGT TCGACTCGCT GACCGCGGTG
53401  GAGCTGCGCA ACCGGATCAA CACGGCCACC GGTCTCCAGC TCTCCCCCAC GGTGGTGTTC
53461  GACTATCCGA AGCCGACCAC GCTGGCGACG AGGCTGCGTA CGGAGTTGGT CCCCACGGTG
53521  AACGGGGACG TGGACGGGGA CGGGACCGCG GACGGCGGGG CCGCCGGCGC GGACGGCCGC
53581  GAGCGGGAGA TCCGGCGGGT GCTGGCTTCG GTGCCACTGC GCCGCTTCCA CGAACTGCGG
53641  GTGCTGGACG CGCTGGTGCG CCTCGCGGAC TCCGCGGCCG GCGACCTGAG CGGTCTGCGC
53701  GACCTGGGCG ACCTGGGCGA CCTGGGCGAC CTGGGCACCG CCGCGGAGGC GGAGACCTCC
53761  GCGCTCGCGG AGCTGGATGC CGACGAGCTG GTGAGCCGGG CGATGCGCGG CACGACCTTC
53821  GGAAACGACT GACGCCGCGG TTGCGGAGAG GAGTACACAT GGCTGCGTCC CGGGAAGACC
53881  TGGTCAAGGC GCTGCGTACC TCGCTGATGG ACGCCGAGCG GCTGAAGCGG GAGAACGACC
53941  GGCTGATCGC CGAGTCCACC GAACCGGTGG CGATCGTGGC GATGGCGTGC CGGCTGCCGG
54001  GTGGGGTGAC CGACCCGGAG TCGCTGTGGG AGCTGGTGGA CGAGGGCGG GACGCGATCG
54061  GGCCGTTCCC CACGGATCGC GGCTGGGACC TGGAGACCCT GTTCGACTCC GATCCGGACG
54121  CCGTGGGCAA GTCCTACGTA CGCGAGGCGG GGTTCCTGGA GGGGGCGGGC GGATTCGACG
54181  CCGCCTTCTT CGGCATCTCG CCGCGCGAGG CCCTGTCGCT GGACCCGCAG CAGCGGCTGC
54241  TGCTGGAGAC CGCGTGGGAG ACCTTCGAGC GGGCGGGGAT GGATCCGCGG TCGGTGGAGG
54301  GCCGGGACAT CGCGGTGTTC GCCGGGGGCA GCGGCCAGGG GTACGGCGGC GGTCCGGGTG
54361  AGGCGCCCAA GGGCTGGAG GCTATCTGG GGGTCGGCGC TTCCGGCAGT GTCATCTCCG
54421  GGCGCGTGTC GTACACGCTC GGGCTGACCG GTCCCGCCGT GACCGTGGAC ACCGCCTGCT
54481  CGTCCTCGCT GGTGGCCGCC CATCTCGCCG TGCAGGCGCT GCGGTCCGGC GAATGTTCCA
54541  TGGCGCTGGC CGGTGGTGTC GCCGTGATGG GCCAGCCCAC CGCCTTCGTC GAGTTCTCCC
54601  GGCAGCGTGG CCTGGCGCCC GACGGGCGCT GCAAGTCCTT CGGCGCGGGC GCCGACGGCA
54661  CCACCTGGTC CGAAGGTGTC GGGCTCGTTC TGCTGGAGCG GCTGTCGGAC GCCCGCCGCA
```

```
-continued
54721 ACGGCCACGA AGTGCTGGCC GTGATCCGGG GCACCGCGGT CAACCAGGAC GGCGCCTCCA

54781 ACGGACTCAC CGCGCCCAAC GGCCCCTCCC AGGAGCGGGT GATCCGCCAG GCCCTGTCCA

54841 ACGCCGGGCT GACGGTGGCC GACGTGGACG CCGTCGAGGC CCACGGCACC GGCACCGCCC

54901 TCGGCGACCC CATCGAAGCC CAGGCCGTTC TCGCCACCTA CGGCCAAAGC CGCCCGGAGG

54961 GCCGGCCGCT GTGGCTCGGC TCCCTCAAGT CCAACATCGG CCACGCGCAG GCCGCAGCGG

55021 GCATCGCCAG TGTCATCAAG ACCGTCATGG CCTTACGCCA CGGCCGGTTG CCGAAGACCC

55081 TCCACGCCGA ACAGCCCACC TCCCAGGTGA ACTGGACGTC GGGCGCGGTG TCCCTGCTCG

55141 CCGAGGCGCG GGCGTGGCCG GAGACCGGAC ACGCCCGCCG CGCCGGGATC TCCTCCTTCG

55201 GCGTCAGCGG GACGAACGCA CACGTCATCC TGGAACAGGC CCCTGAGGAA GCCGAGGCGA

55261 CCGGGGAGAA CACCGCCGAT CAGGAACCGC CCGTACGCTC GGCGGAGTCC GCCGACCCCG

55321 GCCCGGTCGC CACCGGCCAC GTGGTGCCGT GGCTGCTCTC GGGCCATACG CAGGAGGCGC

55381 TGCGTGCCCA GGCCGCCCGG CTGCTGACCC AGGTGCGCGA GACGCCCTCC GACAGTCCGC

55441 GGGACGTGGG CTGGTCACTG GCCACCACCC GGACCCGGCT GGACCACCGC GCGGTCGTAC

55501 TGTGCGCCGA TGCCGAGCAG GCCGTCGCGG GGCTGGAGGC GGTGGCCTCG GCACGTCCG

55561 CCCGGTCGGC GGTCACCGGG TCCGTGGCCT CCGGAAAGGT GGCGGTGCTG TTCACCGGGC

55621 AGGGCAGCCA GCGGGCCGGA ATGGGCCGCG AACTGCACGG CGCCCACCCG GTGTTCGCGC

55681 GGGCCTTCGA CGCCGTGTGC GCCCAGTTCG GCGACCTGCG CGACGGGGAC GACAAGGTCT

55741 CGCTGGCCGA GGTGATCTTC GCCGAGGAGG GGTCGGCGAC GGCAGCGCTG CTGGACCGGA

55801 CCGAGTTCAC CCAGCCCGCG CTGTTCGCGC TGGAGGTGGC GCTGTTCCGG CTCGTGGAGT

55861 CGTGGGGAGT GCGCCCCGCG TATGTGCTGG GCCACTCGAT CGGCGAAGTG GCGGCGGCCC

55921 ATGTGGCCGG GGTCCTGTCC CTGCCGGACG CCTGCACATT GGTGCGGGCG CGCGGGCGGC

55981 TGATGCAGCA ACTCACCGCG ACCGGGGCGA TGGTCGCGGT GGAGGCGGCC GAGGACGAGG

56041 TGGCGCCGCT GCTCGCGGGG AAGGAGCACA AGGTCTCCAT CGCCGCGGTC AACGGCCCGG

56101 CCTCCGTGGT CGTCTCCGGT GACGAGGACG TGGTCACGGC GGTGGCGGAG ACGCTGGCGC

56161 GGCAGGGCCG CAAGACCAAG CGGCTCGTGG TCTCGCACGC CTTCCACTCC CCCCACATGG

56221 ACGGGATGCT GGACGCGTTC CGCGAGGTGG CGTCGCGGCT GGCCTACGCG CCACCCCGGA

56281 TACCCGTGGT GTCGAACCTC ACCGGCGCGG TCGCCGATCC CGAGGAGCTG TGCTCCCCCG

56341 AGTACTGGGT ACGGCATGCA CGTGGCGCGG TGCGGTTCCT CGACGGTGTC CCCACACTGG

56401 CCGACGAGGG CGTGCGCACC CATCTGGAAC TCGGCCCGGA TGGGGTGCTG ACCGCGATGG

56461 GGCAGGACTG TCTGCCCGAG GCGGACGCGG CGTTCGTGCC GTCCCTGCGT CCGGGCGTCC

56521 AGGAGCCGCA CGCGGTGCTG GCCGGGCTCG CCGGCCTGTA CGTACGGGGT GTGCGGGTGG

56581 ACTGGGACGC GATGTTCGCC GGGTCCGGCG CCCGGCCCGT CGCCCTTCCC ACGTACGCCT

56641 TCCAGCACGA GCACTACTGG CTGGAGCGGG CCGCCGGCTC CGGCGACGTG GGCGCGGTGG

56701 GGCTCGGCGA GGCGGGCCAT CCGCTGCTGG GCGCGGTGGT GCAGCTCCCG GAGACGGGCG

56761 GGGTGCAGCT CAGCGGGCGG CTCTCGGTAC GGGCCCAGCC CTGGCTGGGC GAACACGTCA

56821 TCTCCGGGGC GGTGCTGGTG CCCGGCACCG CCATGGTGGA ACTGGCCGTC CGCGCCGGGG

56881 ACGAGACCGG CACCdCGGTG CTGGAGGAGC TGGTGATCGG GCAGCCGATG GTGCTGCCCG

56941 GCGACACCGC CCTCAGTGTC CAGGTCGTCG TGGGCGCGGA CGAGGGCGGG CGGCGTACGG

57001 TGCGGATCTA CTCCCGTACC GACGGGGGCA CCGACTGGAC CGAGCACGCC ACCGGCACGC

57061 TCGCGGCGCA GGGCCCGGCA CCGCTGGACG GGGCCGCGGG CGGGGCCGCC GTCGAGTGGC
```

-continued

```
57121  CGCCCGCGGA AGCCGAGCCG ATCCCCGTGG AGGACTTCTA CCGCTCGCTC GTCGACGCCG
57181  GATACGCGTA CGGACCGGCG TTCCGCGGGC TCGTCGCCGC GTGGCGCCGG GACGGTGAGA
57241  TCTTCGGCGA TGTGGCGCTG CCGGAGGCGT CCGTCGCGGA GGCCGAGCGG TTCGGCATCC
57301  ACCCGGCGCT GCTGGACGCC GCACTGCACG CGGGCAGCTT CTGTCTGCCC TCCGACCCGG
57361  CGCGACAGGT GACCCTGCTG CCGTTCGCCT GGAACACCGT GCGTCTGCAC GCGGGCGGCG
57421  CGTCCGCGGT CCGGGTGCAT GTCCGCCCGG TCGGCGACGA CGCCTTCTCG GTACGCCTGA
57481  CCGACGGCTC GGGCCAGACG GTGGCCTCGG TGGACTCGCT CACCTTGCGG CCGGTGGACC
57541  CGGCCCAGCT CAAGATCGGC ACGGCCGACG ACGCGCTGTG GACGGTCCGC TGGAGCGAGA
57601  CCTCGCTGCC GGACGGCGCG GTCTCCTGGG CCCCGCTCGG CGAGTCGGCC ACCGGGGCAA
57661  CCGGGGGCTA CGGCGCCACA GGGGACGGCG GAGGCCCAGG GGGCGCGCTT CCCGACGTCC
57721  TCGTGGCCGA TACGCGCGCC TGGGCCGAAG ACCTCACCGC ACCCCCGACC GCGCGGGCCC
57781  GGGAGCTCAC CGGCCGCCTG CTGGAGGAGA TCCAGCGGTG GGTCGCCGAC GACGCCATGG
57841  CCGGGACGCG GCTCGCCGTG GTCACCCGCG GCGCGGTCGC GGTCCACGAC GACACCGAGG
57901  TCACCGACCC GGCCGCCACC GCGCTCTGGG GCCTGGTCCG CTCGGCCCAG GCCGAACACC
57961  CGGGGCGGGT GGCCCTGGTG GATGCCGACG GAGCGTGCGA GGAACTGCCC GCCGGGGTGT
58021  GGTCCGGGGA CGAGCCCCAA CTGGCGGTGC GCGGTGGCGC CGTGTGGGTG CCACGCCTCA
58081  CCCGGGTCGA GCCCGGCCTG CGCGTGCCCG CGCAGGCGTC GTGGCATCTG GACTCGGCCG
58141  AGTACGGCAC CCTGGACAAT CTGGCGCTGC TGCCCGACGA GGCCCAGCCC GCACCGCCGG
58201  CGGCCGGTCA GGTGCGGATC GAGGTCCGCG CCGCCGGGCT CAACTTCCGG GATGTCCTGG
58261  TGGCTCTCGG CATGTATCCG GGCCGGTCGG TGATCGGCAC GGAGGGCGCC GGTGTGGTGA
58321  CCGAAGTCGG TCCGGGCGTC ACGGGCCTGG CCGTGGGCGA CCGGGTGATG GGCCTGTTCT
58381  CCGGCTCGTT CGGACCGCTG GCCACCGCCG ACGCGCGCAC GGTGATCCGG ATGCCGGAGG
58441  GCTGGTCGTT CGGCACGGCG GCCGGGGTGC CGGTGGCCTA TCTGACGGCG CTGTACGCGT
58501  TGCAGGACCT CGGGAGGGTC CAGCCGGGCG AGACGGTCCT GGTGCACGCC GCCGCGGGCG
58561  GTGTGGGCAT GGCCGCCGTC CAGCTCGCAC AGCACTTCGG CGCCACCGTC CTGGGCACCG
58621  CCCACCCCTC CAAGCACCAC GCACTCCACC GGCTGGGCGT TCCCGCCGAA CGGCTCGCCT
58681  CCAGCCGCGA CCTCGCCTAC GCCGACACCT TCCCCACCGC CGACGTCGTC CTCAACTCCC
58741  TCACCGGCGA GCACATCGAC GCCTCCCTCG GACTTCTCAA CCCCGGCGGC CGGTTCCTGG
58801  AGATGGGGAA GACCGACCTG CGGGAGCCCG GCGAGGTCGG GGCGCGGCAT CCGGAGGTCA
58861  CCTACCGGGC GTTCGATCTC GGTGGGGAGG CCCCCGCGGA GCGGGTGCGG GAGTTGCTGC
58921  ACCAGTTGGT GGAGCTGTTC GAGGCGGGCC GGATCGAGCC GCTGCCGGTA CGGCAGTGGG
58981  ACATCACCCG CGCCCCCGAG GCGTTCCGCT GGATGAGTCA GGGGCGGCAT ACCGGCAAGA
59041  TCGTGCTCAC CCTGCCACGC GCCCTGGACC CGGACGGCAC CGTCCTGGTC ACCGGTGGCA
59101  CGGGCACCCT CGGCGCCACG ATCGCCCGCC ACCTTCTCAC CCAGCACGGC GCACGCCATC
59161  TGCTGCTGGT CAGCCGCCGG GGACCGGACG CACCTGGCGC CACAGACCTG ACCACCGAAC
59221  TCACCGAACT CGGCGCCACC GTCCGCATCA CCGCCTGCGA CACCGCCGAC CGCGACCAAC
59281  TCGCCGCGCT CCTCGCCGAC ATCCCCGCCG ACCACCCCCT CACCGCCGTG GTCCACACGG
59341  CCGGGACCCT CGACGACGGT GTCCTGACCG CGCTCACCCC GGACCGCCTC GACACCGTCT
59401  TCCGCCCCAA GGTCGACGCC GTCACCCATC TCCACGACCT CACCCGCGAC CACGACCTGG
59461  CGGCGTTCGT GGTGTACTCG TCCGCCGCCG GAGTCCTCGG CGGGCCCGGC CAGGGCAACT
```

```
-continued
59521 ACTCCGCCGC CAACGCCTAT CTGGACGGAC TCGCACAGTG GCGGCGTGCG CACGGGCTCC

59581 CCGCCACCTC GCTGGCGTGG GGCATGTGGG CGCAGACCAG TGGCATGACG GCCGGGCTCG

59641 GCTCCGGCGA TCTGCACCGG GTGCGGCGTG GCGGCATCGT CGGGCTGTCC ACGGCGGAGG

59701 CCCTGGACCT GTTCGACCGG TCGGTGGCGT CCGGGCTGTC CCTGCTGGTG CCGTTGCGGT

59761 TGGACATCGC CGCCCTCGGT GCGGAGGCCG CGGAACCGCC GCCGCTGCTG CGGGGTCTGG

59821 TCCGGCCGGC CCGGCGTACG GCCCGGCCGG TGCCGAAGGC CGGTGAGGGC GGCCTCGCCG

59881 AACGGCTGGC CGGGCTGTCG GCGGCCGAAC AGGAGCGTCT GCTCATCGAG TTGATCCGCG

59941 AACAGGCCGC TTCGGTGCTC GGGTTCCCCA CGGTCGACCC GATCGGGCCG GAGCAGGCGT

60001 TCCGCGACAT GGGGTTCGAC TCGCTGACCG CGGTGGAGCT GCGCAACCGC CTCAACACGG

60061 CCACCGGGCT ACGGCTCCCC GCAACGCTGG TCTTCGACCA CCCGAGCCCC TTGGCCACCG

60121 CCGAGTTCCT GCGGGATCAA CTGGGCGGGC GCGCGGTCGA GGCGGCGCCC CGCCCGGCCC

60181 GGCGTGACCG GTCGGCTCCG GACGGGGCCG AGGATCCGGT CGTCGTGGTC GGCATGGGCT

60241 GCCGCCTGCC CGGCGACGTC CGCAGCCCCG AGGACCTGTG GCGGCTGATC GCCACCGGAA

60301 CCGACGCGAT CGGGCCGTTC CCGCAGGACC GGGGCTGGGA CCTGGCCGGG CTCTTCGACT

60361 CCGACCCGGA CGCACAGGGC AAGTCCTACG TACGCGACGG CGGTTTCCTC ACCGACGCGG

60421 GCGGCTTCGA CGCCACGTTC TTCGGCATCT CCCCACGCGA GGCCCTGTCG ATGGACCCGC

60481 AACAGCGCGT CCTGCTGGAG ACCGCGTGGG AGACCCTGGA ACGCTCCGGG ATCGTTCCCA

60541 CGTCACTGCG CGGACAGGAG GTCGGGGTCT TCGTCGGGGC CAGTGGCCAG GGGTACGGCA

60601 CCGGCCCGGG CGCGGCGCCG GAAGGCTTGG AGGGCTATCT CGGGGTCGGC GGTGCGACGA

60661 GCGTGGCATC GGGCCGGGTG TCGTACACCT TCGGCCTGAC CGGTCCGGCG GTCACGGTGG

60721 ACACGGCGTG CTCCTCCTCG CTGGTGGCCC TCCACCTCGC CGCGCAAGCC CTGCGCTCCG

60781 GCGAATGCAC GATGGCACTC GCCGGCGGCG TCGCCGTCAT GGGCCAGCCC GGCGCCTTCG

60841 TCGAGTTCTC GCGCCAGCGC GGTCTCGCGT CCGACGGCCG CTGCAAGTCC TTCGGCGAGG

60901 GCGCCGACGG CACCAACTGG TCCGAGGGTG TTGGTCTGGT GCTGCTGGAA CGGCTCTCCG

60961 ACGCCCGCCG CAACGGCCAC GAGGTGCTGG CCGTGATCCG TGGCACGGCG GTGAACCAGG

61021 ACGGCGCGAG CAACGGCCTC ACCGCGCCCA ACGGACCCTC CCAGCAGCGA GTGATACGGC

61081 AGGCGCTGGC GAACGCCGGG CTGACGGTGG CCGACGTGGA CGCGGTCGAG GCCCACGGCA

61141 CCGGCACCGC CCTCGGCGAC CCCATCGAGG CCCAGGCACT CCTGGCCACC TACGGCCAGG

61201 ACCGGCCGGG GGACGAACCG CTGTGGCTCG GTTCGCTGAA GTCCAACATC GGGCATGCCC

61261 AAGCGGCCGC AGGCGTGGCC AGCGTCATCA AGATGGTCCT GGCGATACGG CAGGGCACGC

61321 TTCCGCGGTC CTTGCACATC AACGAACCCA CCACCCAGGT GGACTGGACG TCCGGTGCGG

61381 TGTGCCTGCT CACCGATGCC CGCCCCTGGC CGGAGACCGG CCACCCCGC CGTGCCGGGA

61441 TCTCCTCCTT CGGAGTCAGC GGCACCAACG CCCATCTCAT CCTGGAGCAG GCACCTCAGC

61501 CCGAGCCCGA GCCCGCATCG AAGGCGGACG AGGGCACGGA CACCCCTGGG CTGGTCACCA

61561 CCGGCGGAAC CACCCCCTGG GTGCTGTCCG CCAAGACCCC GGCAGCTCTG CGGGCTCAGG

61621 CCCGACGCCT GCTGGACCAT CTGGAATCCG ACATGGACGC ACACCCAGTG CACATCGGCT

61681 GGTCACTCGC CACCACCCGC ACCCTCCACG ACCACCGCGC CGTCGTCATC ACCGACACCG

61741 AAGCCGATAG CGACGAAGCC GCAGCTGCTC TCACCGCCCT CGCGACCGGA CAACCCCACC

61801 CCCCCCTCAC CACCGGCCAC GCCACCACCC ACGGCAAAAC AGTGTTCGTG TTCCCTGGCC

61861 AAGGCGCCCA ATGGGTGGGC ATGGGAGCCC AACTCCTCAA GACTTCCCCC GTCTTCGCCG
```

-continued

```
61921  AACGTCTCCA CGAATGCGCC GCGGCCCTGG CCCCGTACAC CGACTGGTCG CTCATCGACG
61981  TCATCACCGG CACGCCCGAC GCTCCCTCGC TCGAGCGTGT CGACGTCGTA CAGCCCGCCA
62041  CCTTCGCCGT CGTCGTCTCC CTCGCCGCAC TCTGGCAATC CGTGGGCATC CACCCCGACG
62101  CCGTCATCGG CCACTCCCAA GGCGAAATCG CCGCCGCCTG CGTCGCCGGA CACCTCACCC
62161  TCACCAACGC CGCCAAAATC GTCACCCTCC GCAGCCAGAC CATCGCCCAC CACCTCGCCG
62221  GACACGGCGG CATGATGTCC GTCCTCACCT CCCGGGAACA GGTCGAGGAA GCCCTCACCC
62281  CGTGGCACGG CAAACTCTGG ATCGCCGCAC ACAACAGCCC CAACGCCACC GTCATCGCAG
62341  GCGACACCGA CGCCCTGCAC CAACTCCACA CCCACTACAC CGACCAGGGC ATCAGGGCCC
62401  GCATCATCCC CGTCGACTAC GCCTCCCACA CCGGACACGT CGACACCATC AAAAACCAAC
62461  TCCACCAGAC CCTGGCCGAC ACCACGACCG AGCCCGGCAC CATCCCCTGG CTCTCCACCG
62521  TCACCGGACA GTGGATCGAA CCCGACACCG TCGACAGCGG CTACTGGTAC CGCAACCTCC
62581  GCCAAACCGT GCAATTCGAG CACACCATCC ACACCCTCGC CAACGACGGC TACCGCACCT
62641  TCATCGAAAT CAGCCCCCAC CCCGTCCTCA CCACCGCCAT CCAAGAAACC CTCGAAGCCA
62701  ACGACACCCC CAACACCACC ATCACCGGCA CCCTCCGCCG CGACGACGAC ACCCCCACCC
62761  GCTTCCTCAC CCACCTCGCC GAACTGTCCA CCAGGGGAAC ACCAATGGAC TGGCCCACCG
62821  CGTACACCGG ATCACAACCC TCCCAAATCC CGCTCCCCAC CTACCCCTTC GAGCACGAGA
62881  CGTTCTGGCT GGACCGCGGC GCTCCGGGCG ACGTCCGTGC CGTGGGGCTG GAGGACACCG
62941  GCCATCCGCT GGTCGGGGCC GTGGTGAGCG TGCCCGACAC CGGAGGTGTG CTGCTCACCG
63001  GACGTCTCTC CCTGCGCAGC CACCCCTGGC TGGCCGACCA CGCCGTCTCC GGCACCGTCC
63061  TGCTCCCGGG TACGGCGATG GTCGAGCTGG CGGTGCGCGC CGGGGACGAG GCGGACACCT
63121  CCACCCTGGA AGAGCTGGTC ATCAGCCGGC CGATGACGGT GCCGGACGAG GGCACTCTGC
63181  ACGTCCAGGT GCTCGTCGGT GGCGAGGACC GCGGGCGCCG CAAGGTGGGG GTCTACTCGC
63241  GCCCGGAGGG CACACGGCAG TGGACCGAGC ACGCCACCGG CACCCTGACC GGACGGGCTA
63301  CCGGCACCCT GACCGCAGGG GCCACGGCCC CGCCGCCCGA GGCCGCTCAG CCGTGGCCGC
63361  CCGAGGGCTC GGAGCCCGTC GCCCTCGAGG GATTCTACGA GCATCTGGCC GAGGTCGGGT
63421  ACGAGTACGG CCCGGCTTTC CGCGGTCTGA GGGCGGTGTG GAAGCGGGAC GACGAGGTGT
63481  TCGCCGISAG TGTCCGTGCC GGAGGAGCAG ACCGGGGTCG CCGGGCGGTT GGCATCCACC
63541  CGGCGCTGCT GGACGCCACC CTGCACGCCG GGAACTTCTG CTTCCAGTCC GATGGTGAGC
63601  GGCCCACGAT GCTGCCGTTC GCATGGACCG ATGTGCGGCT CCACGCCGTG GGCGCAACCA
63661  CCGTGCGGGT GCGGGCGACG GTGTCCGACG GGGACGGGCT GTGCGTACGG ATCTCCGATC
63721  CGCAGGGCGT ACCGGTCGCC ACGATCGGCT CCCTCCAGCT CCGGGAGACC ACACCCGACC
63781  AGTTGCGCGC CCTGTCCGCC GCATCGGGCG GCAATGCGCT GTGGGCGGTC GACTGGGCCG
63841  AGTGCGGGCT CGATGCCACG GAAGCGCGGT GGGCCACGCT CGGGGAGAGT CGGCTCCCGG
63901  ATTCCCCGCC GAGCTACCCC GATCTCTCCA CGGCTGTGGA GGCCGTGGAA AGCGCGGAGG
63961  CCGGAGAGCG GCCCGCCGTG CTCGTCGCCG ACGTGTCCGC CTGGGTTCCG GAGAAGACCG
64021  GACCCATCGA CCGTACGCAC GCGCTCTGTG CCCGGGTCCT GGATCTGCTG CGGCAATGGG
64081  TGGACCGGCG CGAACTCGCG GACACCCACC TGGTCGTCCT CACCCACGGC GCCATGGCCG
64141  CCCACGACAC CGCCGAGGTC ACCGACCCGG CCGCGGCCGC CGTCTGGGGC TTGGTCCGCT
64201  CGGCCCAGTC CGAGCACCCC GGCCGTATCC GGCTCATCGA CATCGACGAC CACTCCCACC
64261  AGGCCCTGCC CACCGCACTC GCCACCACCG AGGCCCAACT CGCCCTCCGC GACGCCACCG
```

-continued

```
64321 CCTACACCCC CCATCTGACG CCCGCACCCG CCACCACGCC CGAGCCCCTC ACCCTCGACC
64381 CCGAGGGCAC CGTCCTCATC ACCGGCGGCA CCGGCACCCT CGGCGCCCTC ACCGCCCGCC
64441 ACCTCATCAC CCACCATCAC GCACGCCATC TCCTCCTGGT CAGCCGCCAG GGCCCCGACG
64501 CGCCCGGCGC CACGGACCTC ACCACCGAAC TCACCGAACT CGGCGCCACC GTCCACATCA
64561 CCGCCTGCGA CACCGCCGAC CGCGACCAAC TCGCCGCCCT CCTCGCCGAC ATCCCGGCCG
64621 CCCACCCCCT CACCGCCGTC GTCCACACCG CCGGAACCCT CGACGACGCC CTGCTCACCG
64681 ACCTCACCCC GCAGCGCCTC GACACCGTCT TCCGCCCCAA GGTCGACGCC CTCACCCACC
64741 TCCACGACCT CACCCGCGAC CACGACCTGA CCGCCTTCGT CATCTACTCC TCCGCCACCG
64801 GCACCCTCGG CACCCCCGGC CAGGCCAACT ACGCCGCCGC CAACACCTAC GCCGACGCCC
64861 TCGCCCACCA GCGCCACGCC ACCGGACTCC CCGCCACCTC CCTCGCCTGG GGCCTATGGG
64921 AAACCACCAG CAGCCTCACC GCCGGCATGA CCGCCACCCA GCAGCAACGC ACCCGCGACA
64981 GCGGCGTCGT TCCCCTGACC GACGCCGACG GCATGCGCCT CCTCGACACC GCGCTCGCCA
65041 CCCGCCACCC TCATCTCGTC CCCCTCGAAC TCGACCTCGC CGCCCTCCAG AACAACACCG
65101 GCCCGCACAC CCTCCCGCCC CTGCTGCGCA CCCTCATACG CGGCCACCAC CGCCCCACCG
65161 CCCACACCAC AGCCCAGCCC GAGGACGACG CCCCGTCCCT GGCCGAGCAG CTGGCCGCCC
65221 TCGACCCGAC CCAGCGGCAC CAGCGCCTCA CCGCGCTTGT CCGCGCCGAA GCCGCGGCCG
65281 TCCTCGGACA CCCCACCCCG GACGCGGTGG GGCCGGACGA CGCCCTCTTC GAGATCGGGT
65341 TCGACTCGCT GACCGCGGTG GAACTGCGCA ACCGCCTCAA CGCGGCCACC GGCCTCCAGC
65401 TCGCCGCGGC GATGCTGTTC GACTACCCAA CCCCGTCGAT GGCCGCCGAG CACCTCCAGG
65461 AACAGCTCGC GCTGGACGCG GCCACCACGG AAACACACGT GGCGGCCCGG GAAGCGGCGG
65521 AAGACGACGA CCAGAGCACG GAGAGGTGAG ACAAAGCATG TTCGACGTGG CGAAGTATCT
65581 GCGGCGCATC GGGGTGGAGG GGACGCCCCC ACCGACCCTC GACACCCTCC GTCATCTGCA
65641 CAAACGGCAT CTCATGGCGG TCCCGTACGA CAACTCCACA GCCCCCGACC GGCTCCCGGC
65701 CTCGCGGCAT CTGACGAACG TCCCGCTGGA CCTGGTGTTC GGGCATGTGG TGACCGAGGG
65761 CCATGGCGGA GTGTGCTACG AGCTCAACCG GTTGTTCCAC ACGCTGCTGG CGGAGCTCGG
65821 CTACGACGTG CGCATGGTGG CGGCGGCGGT GCGGCAGGCG AACGGGACCT TCGGCCCGGA
65881 GCGGGAGCAC ACCTTCGACC TGGTCCACCT CGATGGCCGG ACCCACCTCG TGGACGTGGG
65941 CTTCCCCGGG CCGTCCTATT CGGAGCCGTT GTACCTGTCC GAAGAAGAGC AGCACCAGTA
66001 CGGCTGCTCG TACCGCGTGA CCGAACACGA CGGCTACCGG GTGGTGGAAC GGCGGCCCAA
66061 GGGGAGCGAC TGGCAGCCGG TGTACCGGTT CCGGCCGGAG CTGGCCGATC CGTCCGGCTG
66121 GGACGCGGTG CGGCTGGACA GCCTGGACGA CTACGCACAG GACTCGGTGC TCCCCGGGAC
66181 CACCTTCCGC AGCCGGGCCA CGGACAACGG GAAGATCGTG CTGATCGGCA GGCGCTACTT
66241 CACCGTCGAG GACGGGGTGG AGCGCACCAA GGTGCTGGTG AAGGCGGACG AATTCCAAGA
66301 CGTGGTCGAC CTGATCCTGG CGGGCGCATG ACCGGGAAGG AGGCGGCAGT GGACACCGCG
66361 CGGGAAACGG ACAGCCTCGA GGCCGAGGTG CTGATCGTCG GCTACGGACC GGTGGGCCAG
66421 CTACTGTCGG TGCTACTGGC CCAGCGCGGG CGGCGCGTGA CGGTCGTGGA GCGCTGGCCG
66481 GAGCCGTACC GGCACCCCCG GGCGGTCGGG TTCGACAGTG AGGCCGCGCG CCTTCTGGCC
66541 TCGGCCGGGA TCGGCGACTC GCTCGACAAG TTCACCGAAC CCGCGCGGGA CCACGCCTGG
66601 CAGAACACGA AGGGCGAGAC GCTGATCGAC CACGAGGTGG CCGACCGGGG GCACTGCACC
66661 TGGCCGGAGG CTTTGTCGGC GTATCAGCCC GCCCTGGAGT CCGCGCTGAT CGAGCACGGG
```

```
66721  GAGACGCTGC CGCCGCTGCG GATCCTGCGC GGATACGAGG CGGTGGGACT CGCGGACGAC
66781  GGCGACCATG TGACCTTGAC CGTGGTCGGC CCGGACGGGG AGAAGACGGA CCTCACCGCG
66841  CTGTGGGTGG TCGGCTGCGA CGGCGCGAAC AGCCTGGTAA GGACGGGCGT CGGCACCACC
66901  ATGACGGACC TCGACTTCTC GTACGACTGG CTGATCTGCG ATGTGCGGTT GCACGAGCAC
66961  CGCGAGTTCC GGCCGAACAA CCTGGAGATC TGCGATCCGG CGCGCCCCCG GACGGCGGTG
67021  TCCGCGGGTC CTGGCCACCG GCGGTACGAG TTCATGCGGG TGCCCGCGGA CGACCCCGAA
67081  CACTTCGGCA CCGTGGAGAG CGCCTGGGAG CTGCTGCGGC TGTTCGATGT GACGCCCGAG
67141  AACGGCGTTC TGGACCGGCA CGCGGTCTAC ACCTTCCAGG CCCCCTGGGC GGAGCGCTGG
67201  CGGACCGGAC GGATGGTGCT GGCCGGGGAC TCGGCACACC TCATGCCGCC GTTCGCGGGG
67261  CAGGGCATGT GCTCCGGATT CCGTGACGCG GCCAATCTGG CCTGGAAACT GGACCTGGTC
67321  CTGGGCGGAC ACGCGGCGCC GACGCTGCTG GACACCTACA CCACCGAGCG GCGGGCACAC
67381  GTGCGGCACG CGGTGGAGAT GTCGGTGGGC CTGGGCCGGG TGGTGTGCAT GGCGGACCCG
67441  GCCGCGGCGG CGGACCGTGA CGCGGCGATG CTGGCCGCGC GCAAACGCAA CATCGGCCCG
67501  AGTGCCGCCC GCCGTTCCGT GGTGAGGCCG CTCGTGGACG GGCTGCTACG GCAGGACGGT
67561  CAGGGCCGCC CGGCACCGTA CGCCGGCCAG GCGGGCCCCC AGTGGCGAGT GTGCCGCGCG
67621  GGAACCACCG GCCTGTTCGA CGACGTGGTG GGCACCGGTT TCGTCCTCCT CTACGCCGAG
67681  GACGTGTTCC CCGCGCTGGA CGCGCGGCGG CTGACATTCC TCGACAGCAT CGGCACCCGA
67741  CTGGTGCGCA TGGTCCCCGC GGACACGCCC CCGGCCGCCC TGGGGCCACG GGACGCGCTG
67801  GACGTGGAGG ACCGGTACCT CTCCTATCTG TCGGAGATGG ACGCGCTGGC GGTACTGGTA
67861  CGCCCGGACT TCTACCTGTT CGGCATCGCG GAGGACGAGG GCGAACTCCT CTCTCTCGTA
67921  GACGACTTGG CCACCCAGCT GAGCCCGTCA CCCACTCCTT CGTAAGGCTC CCCTGCCTGG
67981  GCATGGCTGG TCCCTTCCCC CAAGTTCCCT GAGGGAAGGG ACCAGTTGCT TTCACGGCCC
68041  TGCGGCCGTC GAAGCCTCAA GGAGCCCCGC GCGCCTTCCG GCATGCGGCG CACGGCCTCC
68101  GGGCTGATGG CGCCGGCCGC CGTACGAGCG CTGCGGAGGC TCGTCGACGA GATGGAGGCG
68161  CTTCAGGTCG ACCGGGCGCG TGAACTCGGC TGGTCCTGGG GCGACATCGC CGGGTCGCTC
68221  GGCGTTTCGC GGCAGCTCGG CGCACCAGAA GCACACGCGG TGGCGTGCGA AGACCCCGCA
68281  TCCGGCTTCG CGGCCGGGGG CGGGGTCTGA TGGCACCTCG GGTGAGGCGC CAGCAAGGGG
68341  CGCGGGGCTG TGTCGATGTG CGGCTCCGCC GGGTGGGCGC GACCAGCCAC GACGGCGCCG
68401  CGGAAGATCG ACGGCAGGTC AGGTCATATC CACCGGAGCG ATTAGGTGTC CGAAGTGACG
68461  CTCTCCCCCG TCCCCGCCGC GCGGCGGCGT TCGTCGCCCG CCTTGACCAG GGCGTATCTG
68521  ATGGCCAGGG CCGCCGCGTT GACCGCGTGC AACGCTTCCT GCGCGCCGGT GTCAGGGTGT
68581  ATCTGGCCGG TGACGGCGGC CGAGGTGCAC TGGGCGGCCT CCAGGCAGGC GACGCACGCC
68641  TCCACGAGGG CGTCCGGGCG TGTGCCGGAG GATCGGCCCA GTTTCGTCAG CAGCCGGGTG
68701  ATATCCCGGT GCGCTTCGGT GATCGGGTCC GCCGCCATCG GGTCAGTGCC CCCGCGTACC
68761  GTCGTCGGCC AACGGCCCTA TGTCCCCGGC CGGGGCCAGG GTGAGGAACC GCTGCTCCCA
68821  CAGGGCGAAC ACCTCGGTGG CCAGTGCGTC CGACAGCCCG CCCACGGTCT TGGCCAGATC
68881  CCCGAGGGTG GTGGTGCCGT CGACCGCGCC GAGCAGTTCG TACAGCTCGG GCGACACCTT
68941  CGCGGACGGG CCGCCGTCGT AGTCGAGGTG GATCTCGTGG GTCTTGGCTC CCGCCGAGGC
69001  GTCCGGACCG GCCGTCCTGC GCTCGACCAG CCGGGTCACC GGGCGGAACC GCGGCACCAG
69061  AACGCCCAGG TCGGGCGAGG CTTTGCCGCG TACCAGGCAG TCCTCCACCA CCAGAACGTC
```

-continued

```
69121  CAGGTCGGTG GTCAGGAAGC TGGTGACCAC GTCGTCGAGG CTCTGCACGA TGGGTTCGGC

69181  GTTGTTGTTG AAGGAGGTGT TGAGGAGCAC GGGGGTGCCG GTCAGTTCGC CGAATCGCCG

69241  CACCAGGCGG TGGAACCGCT CGCCGGACTC GGCGGAGACG ACCTGTACCC GGGCGGTGCC

69301  GTCCACGTGG GTGACCGCGC CGAGTTCCGT ACGCCGCTCC GGCAGCACCG GCACCACGAA

69361  GGACATGAAC TCGTGGTTGC CATCCGCGCC GGAGAGGTCG AAGTAGTCGC GGGCGGCTTC

69421  GGCGGTGACC ACCGGGCCGA ACGGCCGGAA GCCCTCGCGC TTCTTCACCA TCGCGTTGAT

69481  GCGGGTCCGG TTCTCCTCGG GGCGTGCGTC CGCGACGATG CTGCGGTGGC CCAGGGCGCG

69541  GGGGCCGAAC TCGGAGCGGC CGTACGCCCA GCCGAGCACC TGTCCCTCGG CGAGGAGTCC

69601  GGCCGCGGTC TCCACGGCGT CGTCCGGGAA CTCCACATCG ATCAGCGGCG CCCAGTCGGC

69661  CAACCGTGCC CTGATCTGCT CCCGGCCGCC CAGTGCCGGG CCGAGGCTCG CGCTGAGCAG

69721  CCGCTTCCCC GGGCGCTCCA GCGTGCCAAG GCTCGCCGCC GCGGCGTAGG CGGCGCCCTC

69781  GCCCGCGCCC GCGTCGTGCG AGGCGGGGTG CACGAACACC TCGTCGAAGA GTCCGGACTT

69841  GAGGATCAGC CCGTTGAGGC TGGAGTTGTG GGCGACGCCA CCGCCGAAGC ACAGGCGGGA

69901  GTGGCCGCTG GTCTTCGCCC AGTATTCGAG GATGTGCAGC ACGATCTTCT CGACCGTCTC

69961  CTGGAGCGCG GCGGCGAAGT CGCGGTGCGC TTGGGTGAAC GGCTCGCCCT TGCGGCGCGG

70021  CCGGAAGCCC TCGGCGTAGA ACAGCGGGCT GACCAGGTTC GGCACCATGA TGTTGCCGTG

70081  CAGCTCGTAC TCGCCGTTGT CCTGGAGGGT GTAGAGCTTG GCGAAGGTGT CGCGGTAGCT

70141  CTCCGGGTTG CCCCAGGGGG CCAGACCCAT CACCTTGTAC TCGTCGCCGA AGCCGTAGCC

70201  GAGCAGATAG GTGGCGTTCA GGTAGAGCCC GCCGAGCGAC TTGGGCACCG GGTAGTCGCC

70261  CAGCTTCTCC AGCCGCGTGC CCTCGCCGCG GTAGACGGTG CCGGAGTGCA GTTCGCCACG

70321  GCCGTCCAGC ACCAGGACCA GTGCGGAGTC CATGCCGGAG TGCAGATACG AGGAGTACGC

70381  GTGCGCCTCG TGGTGCGGCA CGTACACCAG CTTCTCGTCC GGCAGGTCCC AGCCCAGGCC

70441  CTCCTTCAGC CGCTGCCGGA TCAGCTCCCG GGAGTAGCGC AGGGGCGCCC TCGGATATTC

70501  GGTGTAGAGG TGGTTGAGGA CGGTGTCGAT GTGGTTCTCG GAAAGTAGT AGCCCACCGC

70561  GTCGACGTCC TCGGGCCGCG CACCGGCCAG GGCCAGGCAC TCACGGACCG CGTTGAGGGG

70621  AAATTTGGTT GTCTTCTTGA TCCGGTTGAG CCGCTCCTCC TCCACGGCGG CCACGAGTTC

70681  GCCGTCGCGG ATCAAGGAAG CCGCCGAGTC ATGAAAGAAC ACCTCTCCGA GCTGCGGCAC

70741  CACATCGGTG TCCGCGGCGG AGAAGTTGCC GTTGAGCCCG AGCACAAGCA CAGTGATCAC

70801  CCAAACCAGT CGGAGGCGAA CGCGAGGATG CGGGGCGGAA GACGCCCGCC GGTCACCGGG

70861  AGCGCGGCAG CGCCGCGTCG GCGAGCTCAG GCGCCGTCAG CCGCAGCGTC GTCGGAGCCG

70921  GCTGGCACGC GGGGGTGAGG TGGAGGCGTT CGACCCCCTC CTCGTCGGGG ACCGCGAGGG

70981  CGACGGTGCA GGCGCAGGTG GTGTCGGCGA ACCCGGCGAA GCGGTAGGCG ACCTCCATCA

71041  TCCGGTTGCG ATCGGTGCGC CGGAAGTCGG CGGCCAGGTG CACCCCGCCC TGCGCCGCCT

71101  GATCGGCCAG CCAGCTCAGC AGGGTGGACC CGGCGCCGTA GGAGACCACG CGGCACGAGG

71161  TGGCCAGCAG TTTCAGATGC CACACCGCGG GGTGCCGTTC CAGCAGCACG ATGCCGACGG

71221  CCCCGTGCGG ACCGAACCGG TCGGCCATCG TGATGACCAG CACCTCGTGT GCGGGGTCGG

71281  TGAGCAGTCC GCGCAGTGCG GAGTCGGGGT AATGCACACC GGTGGCGTTC ATCTGGCTGG

71341  TGCGCAGGGT CAGTTCCTCG ACCCGGGACA GCTCCCGCTC CGTGGCGCGG GAGATGCCCA

71401  TGCGTATGTC CAGGGTGCGC AGAAAGTCCT CGTCGGGCC GCTGAACTCG GCCCGCTCGG

71461  CGTCACGGCG GAACCCGGAC TGGTACATGT TCCGGCGCTG CCGCGAGTCC ACGGTGACCA
```

```
                          -continued
71521  CGGCGGGGCT GAACTCGGGC AGCCGGGTGA GCCCGGCCAG GTCCTCGGCC GCGTAGCAGC

71581  GCACTTCGGG GAGCCGGTAG GTGACCTCGG CCCGTTCGGC GGGCTGGTCG TCGACGAACG

71641  CCATGGCGCG GTCGGCGAAG TTCAGCCGAT CGGCGATGGC GCGCAGCGAT GCGGACTTGG

71701  GGCCCCAGCC GATGTGCGGC AGTACGAAGT ACTCGGCCAG GCCCAGCGCT TCCAGGCGCT

71761  CCCAGGCGTG GTCGTGGTCG TTCTTGCTGG CGATCGACTG GAGAATGCCG CGTTCGTCGA

71821  GGGTGGTGAT GACATCGCGC ACCCACTCGA ACGGCAGCAC CTCGCCGTCT TCGAGCAGGG

71881  TGCCGCGCCA CAGTGTGTTG TCCAGGTCCC AGACGAGACA TTTGACGGCC GTCGGCGGCT

71941  CGCTCACGGG CTTCCCCTCC GTCATGCTTG CACCTTCTTC CGCGTGTGCT GGGCGAGGAC

72001  GAGCTGGCAG ATCTCGCTGG TGCCCTCGAT GACTTCCATC AGCTTCGCGT CGCGGTAGGC

72061  CCGGGCCACC ACATGGCCGT CGGATGCCGC GGCCGACGCC AGGAGCTGTA CGGCGCGTGC

72121  CGCGCCCTCG GCGGCCTCGC GGGACGCGAC GTACTTGGCG TGCACCGCGT CGACCGCCAT

72181  GTCGGGCGAG CCGGTGTCCC AGGAGGCGCT GGCGTGTTCG CAGGCCCGGG TGGCGTGCCG

72241  CTCCGCGACG TACAGTTCGG CCAGGTGCCG GGCCACCAGC TGGTGCTCGG CGAGTTTGCG

72301  GCCGGACTGT TCCCGGCTGG CGGTGTGCGT GGCGGCGGCG TCCAGGCAGG CGCGCAGGAT

72361  GCCGACGCAC CCCCACGCCA CGGACATGCG CCCGTAGGTG AGCGCCGCGG TGGTCGCCAG

72421  GGGCAGCGGC AGTCCGGTGC ACCGAGTAC GTGGCCGGCG GGTACCCGGA CCGCGTCCAG

72481  GGTGATGTCC GCGTGGCCGG CGGCGCGGCA GCCCAGCGGG TCCGGCACCC GCGTGATGCG

72541  GACGCCGGGG GCCTGGGCGG GCACGACCAC GGCCGCGGCG CCGCCGCGGT ACTTCCCGAA

72601  CACCACCAGC AGGTCGGCGT AGTGGGCGGC GGTGATCCAC ACCTTGCGCC CGGTGACGAC

72661  CACGTGTGTG CCGTCGTCGG CGATCTCGGT CTCCATCGCC GCCAGGTCGC TGCCCGCCCC

72721  GGGCTCGCTG AATCCGACCG CCGCCAGGTC ACCGGAGGTC AGCCGGGGCA GAAAGGTGCC

72781  CCACTGCTCC GCACCGCCCA GCCGCCGTAC GGTCCATGCC GCCATGCCCT GGGACGTCAT

72841  CACGCTGCGC AGCGAGCTGC ACCGGGCGCC GACCGCCGCG GTGAGCTCCC CGTTGGCATG

72901  GCTGTCCAGT CCGGTGCCGC CGTGCTCGGC GCCGACCTGC GCGCACAGCA CACCGGAGGC

72961  GCCGAGTTTG ACCAGGAGGT CGCGGGGCAG CTCCCCGGCC AGGTCCCAGG CGTCCGCCCG

73021  GTCCCCGATC AACCCGCTGA CCAGCTCCGT ATGGCTGGTG GCGGCGTCGG TCACGGCTGT

73081  GCCCCGCGCA GCCGCAGGAC CATCGTGGTC ATCGCGTTGA CCGTGCGGAA GTTGTCCAGC

73141  GCCAGGTCGG GGCCGGTGAT CACCACGTCG AAGGTCGACT CCAGGTGCAC GACCAGCTCC

73201  ATGGCGAACA TCGAGGACAC GGCGCCGGTG CCGAACAGGT CGGTGTCCGG GTCCCAGGTC

73261  TGCTTGGTGC GCTGTTCGAG GAACTGCTGC ACCTCCTGCG CCACCGTCTC GGCGGTGTGG

73321  CTGCCCGGCT CGGATGAGAT GGTCACGCCA GTTCCTTCCC GTATGCGTAG AACCCGCGGC

73381  CCGACTTGCG GCCCAGGTGG CCGTCGCGGA CCTTCTTCAG CAGCAGTTCG CACGGCGCGC

73441  ACCCCGCGTC GCCGGTACGT AGCTGCAGCA CGCGCAGCGA GTCGGCGAGG TTGTCCAGGC

73501  CGATCAGGTC CGCGGTGCGC AGCGGCCCGG TGCGGTGGCC CAGGCAGTCC CGCATGAGTA

73561  CGTCCACGGC CTCCACCGTC GCCGTGCCCT CCTGCACCAC CCGGATCGCG TCGTTGATCA

73621  TCGGGTGCAG CACCCGGCTG GTGACGAACC CCGGCCCGTC GCCGACGACG ACCGGCTTGC

73681  GCTCCAGCGC ACGCAGCAGA TCCGTCACGG CGGTCATCAC CGCTTCCCCG GTACGGGGC

73741  CGCGCATCAC CTCCACCGTC GGGATCAGAT AGGGCGGGTT CATGAAGTGG GTGCCGACCA

73801  GCCGTGCCGG ATCGGCGATA TGACCGGCCA GTTCGTCGAT CGGGATGGAG GAGGTGTTCG

73861  AGATCAGCGG CACCCGCGCT CCGGTGAGCC CGGCGACCGC TTCGAGCACC TTGGCCTTGG
```

-continued

```
73921  TGGGGGTGTC CTCGGTGACG GCCTCCACCA CGGCGGTGGC GTTCCGGCCG TCGGCCAGGG
73981  ACGCGGTGAC CGTCAGCTCG CCCTGCGGGC GACCGGCCGG CAGGGCTCCC ATGAGCTGCG
74041  CCATGCGGAG CCGTTCGGTG ACCGCGGCCC GTGTTCGGCC GGCCTTGGCC TCGTCCACCT
74101  CGACGACCGT CACCGGGATT CCGTGCCCGA CGACGAGAGA GGTGATTCCC AGTCCCATCG
74161  TTCCTGCGCC CAGCACCGTG AGCCGCGGCG CTTCCGCATC TCCGCTCATC AATCGCCTCC
74221  GCAGCGCGTT GTGAACAACG TGCCGACCAT GACACGCGCT TCCGCGTTCA CGGTATTCTC
74281  CGGGCGGTCA CCCAAATCCC CTAAGGATCC CCCCTATACC CCCCTCAGCC GGAATATGAG
74341  TTCCAGCATT CTGGAAGACG CCATTGCGCG GCGCATCGAC GGATTCTTAG CATGGGCCGC
74401  ATTGCCTTTC CCTGAACCTT CCCTTTTCAG CTTTGCGGGG TGCGGAAATC CAATGGCTCA
74461  GCAAGTCGAT GTGACCGAAG AAATTCTCGG ATATGTCCGG GAACTGTCCC TGCGCGATGA
74521  CGAGATTCTG GCCGGGCTGC GGGCACAGAC CGCGGGTCTG CCCGCCGCGC AGGCCATGCA
74581  GGTGATGCCC GAGGAGGGCC AGCTCCTCGG GCTGCTGGTC AGGCTCGTCG GCGCCCGTTC
74641  GGTGTTGGAG ATCGGCACCT TCACCGGATA CAGCACGCTG TGCATGGCGC GGGCCCTGCC
74701  GGCCGACGGC ACGCTGGTGA CCTGCGACAT CACGGCGAAG TGGCCGGGGC TCGGCCGCCC
74761  GTTCTGGGAG CGCGCCGACG TGGCGGACCA CATCGACGTG CGCATCGGCG ACGCCAAGGA
74821  GACACTGGCC GGACTGCGGC GGGAGGGCCG GGAGTTCGAC CTGGTCTTCA TCGACGCGGA
74881  CAAGACCGGA TACGCGCACT ATTAGGAGGA GTCGCTGGCG ATGCTGCGGC GTGGCGGGCT
74941  CATCGTCCTG GACAACACCC TCTTCTTCGG CCGGGTGACC GACCCAGCCG CGCAGGACGC
75001  CGACACCGCC GCCCTGCGCG AGGTGAACAA GCTGCTCCGG GAGGATGGCC GCGTCGAGAT
75061  CAGCATGCTC ACCGTGGGGG ACGGCATCAC GCTCGCGGTC AAACGCTGAG TCCGCGGCTG
75121  AGCGTCTGCG CGGCTGAGCG TCTGAACGTC TGAACGTCTG ACGGCCATGT TCCGGGGGTC
75181  TCCCGGGACA TGGCCGTCCG CGCGGCTCCG CTGTCAGGCG CGCCGCGCCC CGGTCACGCC
75241  AACTCCGGCC GGTCGACGTA CAGTTCGGTG GGCAGTTGCT CCCGGTGCTT GATGTCCAGC
75301  TTGCGGAACA CCCGGGTCAG ATGCTGCTCC ACCGTGCTGG CCGTGACGTA CAGCTTCCCG
75361  GCGATCTCCC GGTTGGTGTA GCCCATCGCG GCCAGCGACG CGACACGCCG TTCGGAGTGC
75421  GTCAGCCGCT CGATCGCGGT GTCCGACTTC GGCGTTGGTG CGGTGGCATG GTGCTGGTCG
75481  TCGGCCGGCA GCCACTCCTC GTACAGCGAC GCCGCGTCGC ACATCTTCGC CACATGCCAG
75541  GCCCGGCGCA TGGTCCGGCG GGCCTGCTTC TTCTCACCGA GCGCGTGGTA CGCCTGGCTG
75601  AGGTCCCACA GCGTGCGGGC CAGCTCGTAC TTGTCCTCCT GCTCGGTGAA CAGGCCCACC
75661  GCCTCGTTGA GCAACTGCGG CCGCCGCTTC GCCGAACTGG TGGCCGCCAG AAGACGCAAC
75721  GACTGCCCGC GGGCCCGGGC GCCGTCCGTG TGCGGACGGC TGAGCTGCTG GTACACCAGG
75781  ATCCGGGCCT GGTCGTGGTT GCCCTGCGCC AGCCATGCCT CCGCCGCCCC GATCCGCCAC
75841  GGCACCGGGT CGCAGCCGCT GCTCAGCCCC CAGTCGGTGA GCAGTTCACC GCACAGCAGG
75901  AAGTCCGCGA GCGCGGCCTG GTGCCGGCCG GCCGCCAGGA AGTAGTGGCC GCGCGCGTAC
75961  AGGTAGTGCA GCCCGTAGGA GCTTTTGAAC ATGGCGTTGG GCACGGTCTG CGCGACATGG
76021  AACCCCGCCT CCTCGTGCCG CCCCATCCGC GTACACGCCA GGATGAGGGC GCCGAGCGGC
76081  AGCCCGATCG CGACACCCCA GGCGCCGGGG GAGGCGTGGG TGAGGGCGG CGCGGGACTGC
76141  TCCGCGGCCT CGGCGAGGTC ACCGCGGCGC AGTGCGATCT CGGACCTGGC CGCCGACAGC
76201  ACCGCCTGCC GCATCGGGAC GTGCGGTCCC CCACCGGTCT CGCCGAGCGC ACCCTCGCAC
76261  CAGGCGGACG CCAGGTCGTT CCGGCCGCCG TAGACCAGGG CGAGCAGGGC GAACAGCCCC
```

-continued

```
76321  GCCTGCTCGT GGCATGCCGG GTCGTGCCCG AGCTGCAGTT CGCGCAGCAC CTCCTCGGCC

76381  CGCCGGACGG TGTCATGGGT CTGCCCGCCG GTGAGCACGT CGGCCAGGAC GGTGCCGGCC

76441  CGGGGCCACA CCGCCGCCCG TGTCGCCGCG GAGCCACCGT GGTGTGCCGG GGCCGCCCGC

76501  CGCTCCGCCA GCCAGGGATA GGTGCAGGTG AGTGCCGCCT CGATGGCATG GAGCTGGTCC

76561  GTGGCCGCGG GGTCCTCGCG CAGGTGGGCG AGCAGCCCCT CCACCTCGCT CAGTCCCCCC

76621  TTCCACAGGA GCTGCATGAC CAGGGTGACG CTGTCGGGGA GGCCGAGCCG GCCGGCGCGG

76681  ACGGCGGCGT ACAGCGGTGC GTGGTGCCGC GTGCCGGTGG ACGGATTGAT CTTCCATTCC

76741  GCCCCGGCGA GCTTCGCCTG CAGGGCTGCA CGGCGCTCTT CGTGCGGGCA TTGCTCGAAG

76801  GACTGCTCCA GTAAGTCGAC GGCGATGGAC GCCTCTTCGC CCACCGCCAC CTGCTCGGCC

76861  ACTTCCAGAA GCACCTCGGC CGACCACGAG TCGGGATCT GCCCGGCCCG CACCAGATGA

76921  CGGGCGATCG CGGTGGCGGG CCTGCCCTGG TCGTGCAGCA GCCGCGCGGC CCGCTGGTGC

76981  AGGGTCCTGC GGGCCTGTGC CGGCATGTCG TTGAGCACGC TCAACCGCGC CGCCTCCTGC

77041  CGGAACTCGC CCTCGTCCAT CAGTCCGGCC CCGGTCAGCG CCGCGAGCAC CTGGCTGATG

77101  GGCTCGGGCT CGTGTCCGGT CATCCAGGCG AGGTCGGCGG CGGGCAGGGC GGATCCCACC

77161  ACGGCCAGTG CGCGCACCAC GTCCAGGAAG ATCGGCTCAT GCGGTGCAG GCAGCTCAGG

77221  AAGGACTGGC CGTAGCCGGC CTGGCTGGCC TCGCCGTGTT CGCGATAGTC GGACAGCAGA

77281  GTGTGCAGCA GCAGCCGGTT GCCACCGGTG GCGGCGCAGA TGTCGCCGAC GTGGCGGCGC

77341  GCGGTCTCCC CCAGCTCCGC CACGACCACT TCGGCCACCT GGCCGGGGGA GAGCGGGCCC

77401  AGGCCGATGC GGCGCAGGTG CTGGGCGCGC AGCAGTTCGT AGCGGAGCGG CAGGGACGAC

77461  GGCAGGCTCA AGTCGTCGGT GAATACGGCC GCGATGCGCG CCGAGTCCAG GCGCCGCACC

77521  AGTTGCAGGA GGAAGTGTGC GGAGGCCGCG TCGCTGTGCC GGACATCGTC CACGGCGACG

77581  AGCAGCGGCG TGTGTTCCGC GTGGTCGATC AGCGAGGTGC ACAGCCGGTG GCACAGCCGG

77641  GCGATCCCGG CCTGGTCCAG CGGATCGCCG GCCGCGCGGA GGATGTCCGG CAGCCCCGGT

77701  ACCTCGGGCA GCCCGCCCGG TGATTTCCAG GCGCCGCGGG CCAATTGTGA GACGACCCCG

77761  AAGGGAAGGT CCCGCTCGCT GGGGGAACAC GTCGCTGTGA CGGTGAGATA GCCGGCCTCG

77821  GAGGCTCGCT CGGCGAACGA CCGGAGCAGG GTCGTCTTCC CGCATGCCAG CGGTCCGTCC

77881  ACGAGAAGAG CCTGCCCGGG CCGCACCAAA GAGTCACCGA ATGGATGTCC GAGGTACGCC

77941  GCGGTATGCA ATACCCCGCC CATCGGACGG GAATTCGACT CGGTATTCAA CGGCATGGCA

78001  TAGCTGTAGG GCATGGTGAT GGTCCCCGAT CGAGGTCGAC GGAATACGGA CTCGCGGCCC

78061  TTGAGTCAGA CCAAATTGTT GATCGGGACA CGATTCCATC AGCACGCCCC CGCCCGCCTC

78121  AACCCCTACC GGAACCTCCG CCCCCTAACC GGCGCCACCA CATCTCGTTC TCTTCATCGC

78181  GCCGTCAGTT ATCCGTGGCG GGCGCCGCAC GGTCAACCCC CTATCGAGTC CGTGCGCCCC

78241  TAAAACGTAT GCGGAGAAAC GTCCAGGCGG CTCGGATACC GTGACGCGTC ACCATGCGGG

78301  CGCGCGGGGC ATCGCCGCGA GGGTGGCGCC GACGGTGTCC TCGGCGATCC CGCGCACCAG

78361  TCCGGGCCCC GCGGGCTAT CCAGGACGAA CGTCAGCCCG TCGGTGGCCT TCTTGTCCAG

78421  GCGCATCAGC TCCACCAGCT CGGACACGGA GACATGCGGG GGCAGCGCGG TCGGCAGGCC

78481  GTAGCGGGCG ACCACGTCAT GATGCTCGGC CACGCGCTCC GGGCCGATGC GCCCCAGCGC

78541  GCCGGCGAGC CGGCCGGCGA AAACCGTGCC GATGGCCACT CCCTCCCCGT GCCGCAGCGC

78601  GAACCCGGTG GCACGTTCCA GCGCATGCCC CAACGTGTGT CCGTAGTTGA GGAGGTGGCG

78661  CAGGCCCGAG TCGCGCTCGT CCGCGGCGAC GATGCCCGCC TTGAGCGTCA CACTGGCCGA
```

```
                      -continued
78721  GATCTGGTCG AGCAGCGGCA GCCCGTCGAG ATCGGGCGCG CCGATGAAGT GGCAGCGGGC

78781  GATCTCACCG AGGCCGTTGC GCCATTCCCG TTCGGGCAGG GTCTTCAGAT GTTCGAGGTC

78841  GCAGAGCACG GCCGCGGGCT GCCAGTAGGC GCCGACCAGA TTCTTGCCCT CGGGCAGATT

78901  CACCGCGGTC TTCCCGCCGA CGCTCGCGTC CACCTGGGCG AGCAGCGAGG TCGGCACGTG

78961  TACGACCGGG GTGCCCCGGT GGTAGAGGGC GGCGGCCAGG CCCACCGTGT CGGTCGTGGT

79021  GCCGCCGCCA CAGGACACCA CCACATCCGA GCGGGTCAGT CCGAATCCGA CGAACCGGCG

79081  GCACAGATCG GTCACGGCGG CCAGGTCCTT GGCCGCCTCC CCGTCGCGGG CGGGTACGAC

79141  GAGCGAGGGC ACTCCTGGGT CGGGGGTCTG CTCGGCGGGC CGCGCGGTGA CCACCACCGC

79201  CCTGCGCGCG CCCAGGGCGG CCACCACCTG TGGGAGCAGC CGCTGCACAC CGTGTCCGAT

79261  GTGCACGGTG TAGGAGCGTT CGGCCAGCCC GACGACGACC TGTCGGGCGG GGGAAGCGGA

79321  ACTGGCGGCC GGACTGGAAG TCGACGTGGT CAAGACTGCT TTCCCATCGC TGGCGCGGCC

79381  CCGGCGAGAA GCCGTCTCGC CGGGGCCGGA ATCGGGTGCG TGCGGAGCCC TTTTCAGTCC

79441  TCGACCGCGA TCGCGGCGGC CGGGCACAGG AACGAGGCCT CGGCGACGCT GTCGCGCAGC

79501  GCGAGCGGCG GCCGCGGGTC CAGCAGGACC ACTGTCCCGT CCTCCTCCCG CTGGTCGPAA

79561  ACCTCCGGCG CCGCCAGCGC GCAATGCCCG GCCGCGCAGC ACTTCTCCTG ATCCACCGAG

79621  ACCTTCACCA TCGTGTTCCC CTCATCATCC TTCTGTCATC CGTTCCGCGG TCACCAGGCG

79681  ACGGGCACAC GGGCGACGCC GAAGTTCATC GACTCGTACA AAAACGCCAG GTCGTCGAAC

79741  GGGACCTCCA GGCGGAGCGT CGGCAGCCGG CGCAGCAGGG TCTCCAGGGC GATCTGGAGC

79801  TCGACCCGGG CGAGGGTCTG CCCCAGGCAC TGGTGCACTC CAAAGCCGAA CGCGACATGT

79861  TCGCGGGCGT TCGGCCGGCT CAGGTCCAGT TCGTGGGCGT CCGCGAAGTG GGGGTCGCGG

79921  TTGGCGCTGG GCAGATTGAT GATCACCCCT TCACCGCCCG GGATGAGCAC CCCGCCGACC

79981  TCGACGTCCT CGGTGGCCAC CCGTCCCGTG CCTTCCTGGA CGATCGTGAT GTACCGGAGC

80041  AGTTCGTCCA CCGCGTTGCC CATCAGCCCG GCGTCCGCCC GCAGCCGGGC GAGCTGTTCG

80101  GGGTGGCTCA GCAACAGGAC GGTGGACAGG GCGATCATGT TGGCGGTGGT CTCGTGCCCG

80161  GCCAGCAGCA GCACCAGGGC GGTGGCGACC ACCTCCTGCT CGGTGAGCCC GCCCGTCAGC

80221  TCCTGGTCGA CGATGAGCCG GCTGAGGAGA TCGTCTCCCG GGTCGGCGCG CTTGGCCGCG

80281  CACATCCGGG CGACGTAGTC CACCATGACG CCGAGCGCGG CGCCCATCTC CTCGGCCGAC

80341  GCGGTGAAGT CCATGACGCC CTGCGACGCC TGCTGGAACT CCGCGAAGTC GGCGTCCGAG

80401  ACCCCCAGCA TCACACCGAT CACCTGGGAC GGCAGGGGA AGGCGAAGTC GGCCACCAGG

80461  TCGGCCGGCG GCCCCTGGGC GATCAGCCGG TCCAGGAGGC CGTCCACGAT GCCCTGGATC

80521  ATCGGCCGCA TCGCCTCGGT GCGCCGGATG GTGAAGTTCG CGGTGAGCAT GCGGCGGATC

80581  CGGGCGTGCT CCGGATCGTC CATCCTCCCG AGGTTGAACA CCTCGGCCGG CACCTCGAAC

80641  TTCACGAAGC GCGGCATCCC CTTGTGCGTG CCGTCGGCGC TGAACCTGCT GTCGCCGAGC

80701  GCGGCCCGCG CCTCGTGATA GCCGGTGACG AGAAACGGGG TGCTGCCATC CCACATCCGC

80761  ACCCGCGTGA CGGCGGACCG CTCGCGCAAC TCCTCGTATC CCAGCGGGGG TGAGAACGGG

80821  CATGCAGCAG CCCGCGATTC GGGGTAGTCG CGTATCTCGT CCATGCCTGT CCGTCCTGTC

80881  CGTCGCTTCG TCGCCACCAC TGCGCCGCCC TACGGATGGA CAAGTCTGGT CCGCGCACCC

80941  GCTCCCCACT CCCCTAACCA CTCCCCTATG CCCCCTTGGC TTGAGGGCAG GTATCCCCCC

81001  TTGCCTCGGC GGCAGGACAC TCAGCAGGAG GACGATCCGG TGGCTCCGAT GAGCAGCCAC

81061  AGACGACGCG ACAGCTCCTG CCGATTTCCC ACGGAGAGCT TGCGGTAGAT GCGCGTCAGA
```

-continued

```
81121 TGCTGCTCCA CGGTGCTGAC CGTGATGTAG AGGCTCTTGG CGATCTGCCG GTTGGACATC
81181 CCCGACGCGG CCAGGGTCGC ACGCGCCAC TCGGCCTCCG AGATAACGGG CTGCTCTGCG
81241 CCTTCGGCCG ATGCGCCGGG CTCTCTCTCC TCGGACTCCC CGGCGGCTTC CGACAGTCGA
81301 GCGTCCACGG AGCTCTCGGC GCCGTCCACG ACCAGGTCCC TGCGGCTCTC GTGCTGGGCG
81361 CTGATCCCGC ACTCGTCCAT CAGCTTCTGC GCCTCATGCC AGGTGGTGCG AGCCTGTTGG
81421 GTCTCTCCGG TGCTGAGGAA GTCCTGGCTG AGCTCGGCGA GCGTACGGGC GAGTTCGAAA
81481 CGGTCGCCGT GCTCGCGCAG ACACTTGGCG GACTGATAGA GGAGCAGCCT GCGCTTGTCC
81541 GGGTCCTCGG CCATGGCCAG AACGCGCAGC GCTCGGCCAC GGGTGCTCAA GGGGCGGTCG
81601 GGCGAGAGCT TGAGCTCTTC CAGGGCGAGT CTTTTGGCCT CCGCCGGCTC CTGGACATGC
81661 AGATACGCCT CGGCGGCGTC GATGCGCCAG GGCGCCAGGT CGCCGAAGTC CACGGGCCAC
81721 TGGTCCATCA GCATCCCGCT CACCATGAAA TCGCTCAGCG CGGCATAGGA GCGGTTGGTG
81781 GCCAGACAGT ACTGTCCGCG AGCCCGGAGG TACTCCAATC CCACAACGCT GTCGAACATT
81841 TCCTTCGGCA CCCAGTAACG CAGATATCGC TCGGCCTCAT CGAGTCTGCC GATCGCGGTG
81901 TGGGCCGCCA CCAGAACGGA GAGCGGCAAT CCGATGGCGA CGCCCCATCC GCGCGGGGGG
81961 ATGGAATTCA GTGCGGTGCC GGCGAAATCG ATGGCCGAGG TGAAGTCCCC ACGGCGGCAT
82021 CTGATGTAGG CGCGCATGGA CAGGGCGACG GCGCCGGGCG TCTTCATGTT CAGCTTGTCG
82081 GCCGCGGTGA AAAGCGCGCC GCACAGCCGG TCCGCCGTTT CCGCTTCTCC TCTCGCGGCT
82141 AATGCCCAGA CCATCCGGCA GGCGTATGCG TACGCGAACC AGAAGTGATT GGAGGGCGAC
82201 AACAGATGCA TGGCATCGGG AGAGAAGTCC GCCACCTGCC GGGGATCCTG GAAATGCCCG
82261 ATCTCCATGC CCAGTTCGCC GACGGACAGC TGCAGACCGT GCTCCAGGTT GGCCGCCCAC
82321 AGCCCGTCGA CTTCCCCGTC CGAGAGAGGC TGGTCGGGGA AGTCATGGAT CAGGGTCGGT
82381 TTAAGGAAGG TGGCCCACTG CCGGGTCACC CGCAGAGCGG CCATGCTGGA CGCGTTATCG
82441 GTGTCACCAC CGCCCGACAG CCACTTGAAG CTTCTTCCC CATCGCTGAA CCGGCCGAAC
82501 CACAGCACCA TGAAGAGCAG GAAGCACAGA TACCGCTCGG GGATGTCGGC GGGGAATTCC
82561 TCCCGTATCG CGGCCAACAG GCGGTCCAGT TCGGGTTCGG CGGTCGCCGG ATTGCTGGAC
82621 CATAACGCCC CGACCAGCGC CATGAGAATG TCCATGTGCT CCCGCCGGCC GAGGTCCGCG
82681 CGGGCGGCGA GCCGCAGGCC GGCGATCGCT TCCTCCGTAC GGCCGTGGTC GAGATTCTTC
82741 TGGGCCGCGT GCCAGAGCAC TGTGACGCCT TTTTGGTCGG GCGTTTTATC GGCGGTGACC
82801 AGAAGTTCCG CCACCGCGAT CGGGTCGGCC CCGTCGGCAT ACAGAAGTTC GGCCGCTTTC
82861 GCGCTGAGGC GGGCCCGGTC CTCCGCGGGC AGCGTCTCCA GCGTGGCGTA TCGCGCCGCG
82921 GGGTGCCGGA AACGTCCGTC CTCCAGCAGT CCCGCGGAGT TCATGATGGT GATGGCCCGG
82981 GCCGCGCGTT CCTGGCCGCA TTCGAGCAGA TTGGCCACCC GCCACGGGCT GCCGTACCGG
83041 TCCAGCACCG CGAGGGCCTG TGCCACCTGG AGCAACGCCG GATGGGATAA CAGACACCCG
83101 CGATAGGCCT CCTGGAACTC CGCACCGACA GTGACAGCAG TCTCCGGCCC GCCCGGAGCG
83161 GCTTGGAGAT GGTCGCGCAG CAGGGCCTTG ACCAGTCTGG GATTGCCACC GCTGACGGCG
83221 TGGCAGGAGG CGCGGATCCG GTCGGCCAGG TCGGCGTCGC TGTGCCGCTC CAGCAGGTAT
83281 CCGACCCCGG ATTCCGGGAG TGTATCGATC TTGATCTTGT AGAACTCGTG GAAGCCGTGA
83341 GTCGGGCGC ACAACGGATG TGTCTGCCCG CCGGTCATCA CGACGAGTGT GCGAGTGCCG
83401 GACGCATGCC TGGCGATATA CAGAAGGCAC ATGAGGGAGG GGTAGTCGGC ATGCTCGGCA
83461 TCGTCAATCG CGATGATCAG CTGCTTGCCG CCCGCGATAC GGTGCAGCAC ATCGGATATT
```

-continued

```
83521  TCACGGACCA GGCTTCTCAG CATGCCGGGT TCGGCCTCCG AATACCGCTC TCCGGCAGTC

83581  CTCCAGCGCG CCACGACGTC CAATTCGCCC ATGAACGCGG AGGACCAGAT CAGCCGTTCC

83641  ACTATGTTGA ACGGGATGGC GGTGTCGTCC GCGAATCCGG ACGCCGTAAG ACAGACCGCA

83701  CCCGACTCGG CCGCCTGTTC CTTCAGACAG CCCAATAAGG AGGTCTTTCC GACACCGGGC

83761  CCCCCGGTCA CTTGGAGAAG CCCGCCGTTG CCTCGTGCTG CCGCGTCGAG ACGTCGCGA

83821  AGCTCGAATT GATAATCTGT CAGTCCCATA CTCATCAGTC CTCGCTGTGG GGGTGTGCGT

83881  CTGAGCGATG AGTTGATCTC CGCAGTCATC CCACCCTGCG GAAGAAGGCT TCTCTGACGA

83941  GACAGATAAC CGCTGCGCCG ACGGCGGCCG ATTCCCTGAT CTGGATCACC TCCGGTGGGA

84001  GCCCATGTCC TTGACGTTCA TACAAGCAGA GTCACAACCG GAGCGAAACC TTCCACCGAT

84061  CATGATGAAC CACGGTTTCC GACCCCCGTG TGAACGTGCC TGCCCGAGCG GGCGGCCCCC

84121  TTCCTCGCAC CCCCGAGAAG GGCGGGGCGC CACCGGTGCC GACGCGCAGG AGAAATGCGA

84181  TGTGCGGCAT GCCGACGCGA ATGCACCTCG GACTCTGAAC CGGTTATGGA CCCGGCAGCA

84241  TTCCTTGCCC TGTGCAAAGC TGGCGGTTTA CCAGCAGCCG CCCCGGCCGG TCGCCGCTCC

84301  ACGCCCGTCC CAGCGGGCTC CGGAGCGGCA AGTGCCCCAC CTGCGGTCAT CCCCCGGTTG

84361  CCTCAAAGTC ATGTCGCGTA CCATTCCCGG CAACCTCCTC GCCCCTCAGC AGATATGTCT

84421  GCCCCCGACT CGCGACGGAG ATACGGGAT TGACCCCTAT ATGATCACCG CGACAGCGCG

84481  ACCATAAACG GCCGCCGCCC CATGATTCCC CTAAACTCTT CGCCGTGATT TGGCCGGGAT

84541  TTATCTGCCT GCAAAACGGC CGAAACGGGT GCGCCGTGGA CCGAGCCCGG GCCGGACCC

84601  GCGGCATACG ACGCCGGAAG TCCTGGCTCC TGGCCACTTC AGAGACGAGG GAGCGTGAAC

84661  TGTGACCGTC AAGGGCGCGT TGTTCGACTT CTCCGGGACG CTGTTCCGAA TCGAGTCCGC

84721  CGAGTCCTGG CTCCGCACCG TGCTGGAGCG GAGCGGGACC GCGGTCCCGG ACGAGGATGT

84781  CCTACGGTAC GCGCGGAACC TGGAGGAGGC CGGTGCGCTG CCCGGCGGCG CCCCGCCGCT

84841  CGCGGTGCCG CCGCACCTGG AGGAGGTGTG GGCCGTACGG GACCGCGGCG CCGAGCCGCA

84901  CCGGGCCGCC TTCACCGGTA TGGCCCGCGA GGTGCCGCTG CCCCGCCCCG AGCTCTACGA

84961  CGCCCTCTAT GACCGCCATA TGGAGCCCGC CGCCTGGCGG CCCTACCCCG ACGCCCGCGA

85021  GGTGCTGGGC GAGCTGCGCC GGCGCGGGGT GCGGATCGCG GTGGTCAGCA ACATCGGCTG

85081  GGATCTGCGC CCGGTCTTCC GCGCCCACGG CCTGGACCCG CTGGTGGACG CCTATGCGCT

85141  CTCGTACGAG CACGGGGTGC AGAAGCCGGA CCCGAGGCTG TTCCAGGCCG CGTGCGACGC

85201  GCTGGGCGTG GCCCCGGGCG ACGCGGTGAT GGTGGGCGAC GACCGCCGGG CGGACGCGGG

85261  AGCGGCGGCC CTGGGCTGCC GGGTCCACCT GGTGGACCAT CTCCCGGTGG ACCGGCGTCC

85321  GGACGCCCTG CGCGCGGTTC TCGGCCTGCC GCCGGACGCC GCCACGGCCC CCTAGGCCCC

85381  GCGGAACGAA GCCCGAAAGG GATCTCACGG GGCGAACCCA CCGGTTCGGG CGATCCCCCC

85441  ATGCCGCCCG AACCGGCGGA GACATACGGC GGCCCTCGAA GGATCGGCGG ACAACCGAAC

85501  GTCGCCTGAG TATATTGGCT GACAGCCAGC CAACGCAGGA GTTACAGCAT GGTCCCCCGA

85561  AGCCCGTCGG TCAATGAGGA GTTGCGCCGC CGATCCCAGG CCCGTCTGCT GGAGGCGACG

85621  GTCGAGCTGA TCGACGAGCA CGGCTACGAG GCGACCACCC TCGCCCATAT CGCCGACCGG

85681  GCCGGGGCGG CC
```

HERBIMYCIN CLUSTER (SEQ ID NO:2)

```
   1 CGGGCGGATC TCCACCTCGG TGTCGGGTCG CTGCTGCGGG CGGGTCGCCC AGCGGCGGCG
  61 TACAGGGGCG TCACAGTGGC TTCCGCGCGG CAGGTGCGGC GGGCCGGGAA GGGCGGTGGC
 121 CGGCCGGCGA CGGCTGCCAG GCGCGTAGCC GCAGGCTGTT GCCGACCACC AGCAGCGAGC
 181 TGACCGACAT CGCGGCCGCC GCGAGCATGG GGTTGAGCAG GCCGACCATG GCCAGCGGTA
 241 CGGTCACGGC GTTGTAGCCG AACGCCCAGA GCAGATTGAC GCGGATCGTG GCGAGCGCAC
 301 TGCGGGCGAG GCGGACCGCG TCCGCCAGGG TCTCGATGTC ACCGCGTACC AGGGTCACAT
 361 CGGCCGCCCC GATCGCCACA TCCGTGCCCG TGCCCATGGC GATGCCGAGG TCGGCGCCGG
 421 CCAGGGCGGC CGCGTCGTTG ACCCCGTCAC CGACGACGGC GACCCGGTAG CCCTGCTCCC
 481 GCAGCTCCCG GACGAGGGCG GCCTTGTCCT CCGGGGTGCA CCGGGCGTGC ACCTCCTCGA
 541 TGCGGAGGTC GGTGGCGACG GCGCGGGCGG GCGCCTCGCG GTCGCCGGTG GCGAGCACCG
 601 GTCGCACGCC CAGGCGGCGG AGCCGCTCCA CGGCCCGGTA GCTTCCCGGG CGCAGCACAT
 661 CACCGACCTC GATCAGTGCC TCGGTCTCGC CGTCGACGCG GACCACGACC GGTGTACGGG
 721 CGGCGGTCTC GGAGGCCGAC AGCGCCTGAG CCAATACCGG GGCAACGCG TCGTCCGGGG
 781 CCAGGACTTC GACCAGCCGG TCCGCCACCC GCCCGCGCAC GCCCTTGCCC GGCAGCGCGA
 841 CGAAGTCGGC CACGGCCGGG AGGGACTTTC CGGGAACGGT GCGCCGGGCA TGGGCGGTGA
 901 TGGCACGCCC AGCGGGTGT TCCGATCCCT GTTCGACCGC GCCCGCCAGC CGGACCAGTT
 961 CCTCCTCGCC GAGCCCGCCC GGTACGCCGG TGACCGGGC GACACTCATC TGCCCGGAAG
1021 TGAGGGTGCC GGTCTTGTCC AGTACGACGG CGTCCAGGTG CCGCAGCCCC TCCAGCGCCT
1081 GCGGTCCGCT GACCAGGACG CCCAGTTGGG CGCCCCGGCC GGTCGCCGCC ATCAGCGCGG
1141 TGGGGGTCGC CAGGCCCAGC GCGCAGGGGC ACGCCACGAC CAGGACGGCC ACGCTCGCGG
1201 TGATCGCGGC CTGTGGCTCG GCACCGGCCC CGAGCCAGAA TCCGAGGACG GTGACGGCCA
1261 GGGTGAGCAC GACCGGGACG AAGACGCCCG CGGCCTTGTC GGCGAGCCGC TGCGCCCGTG
1321 CCTTGCCCGC CTGGGCCTCG GTCACCAGCC GGGTGATCCG GACAGTTGG GTATCGGCGC
1381 CGACCGCGGT GGCCCGTACC AGGAGCAGGC CCCCCGCGTT GACGGCACCG CCGGTCACGG
1441 GCGTGCCGGG GCCGACTTCC ACCGGCTCGC TCTCCCCGGT GACCAGGGAC AGATCGACGG
1501 CCGAGCTGCC CTCCACCACC GTGCCATCGG TGGCCAGGCG CTCGCCGGGC CGGGCGACGA
1561 AGACCTGGCC GACCCGCAGT TCCTCGATCG GGACCAGGCG CTCGCCGTCG CCGTCGCGTA
1621 CCGATACCTC CTTGCCGGCC AGCCGGGCCA GGGCGCGCAG TGCCGCGCCG GTCCCCAGCC
1681 GGGCCCGCGT TTCCAGGAAG CGGCCGGCGA GGACGAACAG CGGTACGCCG ACGGCGGCTT
1741 CCAGATAGAC ATGGGCCACG CCGTCCGAGG CGGTGGGCAC CAGGCTGAAG GCATCCGCA
1801 TCCCGGGTTC GCCGGCCCCG CCGAAGAACA GCGCGTAGGA GGACCAGGCG AAGGAGGCCA
1861 CGACACCCAG CGACACCAGA GTGTCCATGG TCGCCGCCGA GTGGCGCAGG CCGCGCGCCG
1921 CCCGCAGGTG GAAGGGCCAG GCTCCCCAGA CGACGACGGG GGCGGCGAGC ACGAAGCACA
1981 GCCACTGCCA GTTGCGGAAC TGGAGACCGG GAACCATCGA CACGACCAGC ACCGGGACCG
2041 CGAGCAACGC CGTGACCACC AGCCGGTCGC GCTCCCGCCG GGCGTCCTGC GCCGCGTCCC
2101 TGTCCTCGCT CCGTTCCTTC CTGGGCGGCT CGGGCAGCGC GGCGGTGTAG CCGGCCTGCT
2161 CGACGGTGGC GATGAGCTGG TCCGGGCCGA CCTCGGGCCG GTGGTTCACC CGGGCCCGGC
2221 CGGTGGCGAG GTTCACGGTG GCCGTGACCC CGTCCAGCCT GGCCAGCTTC TTCTCGACAC
2281 GCTTCACACA GGCCGCGCAG GTCATGCCGC CGATGGAGAG GTCGGTCATG GCGGCCAAGG
```

-continued

```
2341  CCGTCGGTTC GTCGGCCATC AGCGTCCACT CCCCTGGTCC GTGTCCATGC CGCCCATGTC
2401  CATGCCGCCA CCGCCGTGGC CGTCTCCCGA GCCGCCGTCT GTCGTGCTGC TGCCGTGCAT
2461  GCCGGGGGCG ACGGGCCCGG CGCCCGCGCC GACGGCGTAG GAGGCGGCGA ACACCATCAC
2521  CAGCAGCAGC AGGAATCCGC ACAGCGCCGG CGGGGGCAAT GCCCTGGACA GGAACGCACC
2581  CGGTGTCCGG CGGGCAGATG GGCGGGGCTG CGCCATATGA GGAAACTTCC AATCACTCCG
2641  TACGGCTTCA GCGGATCCGG CCGTACCGGT AGAGGAGTCG GGACGACCGG CAGCCGAGTT
2701  CCGGCGCCGT GCTGTGATGC GCGTCATGAC ACCGGGCTCG TCCGGCGAGC GCGTGACCTG
2761  CTCAGCCCTG TTCATAGTGG CTCGGTCTGC CGTCACGGTG GACGAGACGG CCGAGCCGCT
2821  CCGCGCGGGC GCGGGGCATG AGCGTCCAGG TGCCGTCGGT GCGGTGCAGG GCGGCCGAAT
2881  GCCAGGGGGT GGTCCAGACA TCGGCGGCGT CCAGGAGGCG GATGCCGAAT TTGGCGGCGC
2941  CGATGGGCTG GGGGTGGATG GACAGCCGTA CGGAGCCGGG GTGGTGTTCG GCGATCAGGT
3001  CGCCCCAGGC CCGGCTGCGC TGGATGACGC CGTAGGCACG GGTGCGGCAT GCGCGTTGGA
3061  GGGCGGAGCG GGTGCCGGTG AAGTCGGCGG TGTCGTCGAC GAGGAACCGG GTGATGCCCC
3121  GGTACAGGGC GAGGGTGTGG TCCTCGGAGC GGACCTCGGC TCGCAGCGCC TCCAGGGTGG
3181  GGGCGTACCG CTCGTGCACC TGGGCGCGCT TGGTGTGGTG GGGCAGGTCG CCCAGGATGT
3241  CGCGCAGGTC GAAGACGGAG AGGCGGTGCA GTGCCAACTC CCGTATGAGG CGTCTGAGTT
3301  CGTTTGCGTA GGCGTCTATG TGGTCATCCG GGACGCGGAT CAGGTCGCCG AAGACATGGC
3361  CGTCGGAGCA GATGATCACG CGGGCGCCCG GCGGGTGGAC CCGCTCGATC TCCTCGCACA
3421  GGGTGTTCAG AAAGCCGAGG GAGAGGCGTT CGCCCTGGTC GGGGAGGTGG CCGAGAACCT
3481  TGGCGGGGTT GGGCGACTTG CAGGGGAAGC CGGGCAGGGT GAGGACCACG GGTTCTCCGG
3541  CGCGGACGAA CCCGCCGATC TGGCGCAACT GGTGCGCGAA CGACTCCGCC GCCGTGGGCG
3601  TGGGGTCGGT CGTGCGGTGG TACGGCAGCA GCAGGTCCAG GATGGCGGCC CTCATGCCGC
3661  TCGTGGAGCG GGTGTCCGGT GCGGTCGTCA GCGGCATGAG GTGGGTTCCT CCGTGAGGGT
3721  ATGCGCGACG CGGGCATGGG GGCATGCGGG CATGCGTCAG ACGCGTCGGT CGTAGCCGAC
3781  GGGCAGGTGG TTGGTCCCCC GGCCGAGGAC GGCCGGGATC CACTCGATGT CTCCGTCGTC
3841  GATGGCCAGA TGCGCTCCGA GGAGGCGGGT CAGGAGGGTG CCCAGCGCGA TCTGGAGTTC
3901  GGCGCGGGCC AGGGCCGCGC CGGGGCAGAA GTGGATGCCG TGGCCGAAGG CGAGGTGGGG
3961  GTTGGGCGAG CGGTCGAGGT CGAGGGTGTC GGGGTCGGGG AAGCGGCGCG GGTCGCGGTT
4021  GGCGGCGCAC AGGGAGATGA TCACCGAGTC GCCGGCCGGG ACCTCGGTGC CGTGCAGGTC
4081  GCTGTCCTGG TCGAAGAAGC GCCAGGTGGT CAGCTCGAAG GCGCTGTCGT AGCGGAGGAG
4141  TTCGTCGACC GCGCGGGGCA TCAGCTCCGG GTTGTCGCGC AGCCGGGCGA GTTCGGCGGG
4201  GTGGCGGAAG AGGGCGATCA GGGCGGTGGT GATCTGGTTG GTGACCGGTT CCTGGCCCGC
4261  CACGAGGAGC TGGAAGATCA TCGAGTCCAG CTCCTCCTGG GAGAGTTCGC GGCGGTCATG
4321  GGCCACGACC AGGCGGCTGA GCAGGTCGTC CGCCCAGTGT TCGCGCTTAT GGGCGACGAC
4381  CTCGGCTATG TAGCTCTGGA GTCCGTGCAG ACGGGCCTCG TACAGCGGGC GTCCGGGGTC
4441  GGCCGGTCCG ACCGGCTGGA CGACCTTGCC CCAGTCGCGG TCGAAGCGGG CCGCCAACTC
4501  ATCTGGCAGG CCGATGACTT CGGCGAGGAC CTGGAAGGGG AAGCGGGCGG CGAAGCCGGT
4561  GACCAGGTCC GCGGGGCCGG TTTCCGGGAG GGCGTCCACG AGGGTGTCGG CCAGCTTCTG
4621  GAAGCGGGGC CTCAGTTGCT CGATGCGGCG CGGGGTGAAG GCGTCGGTGA CGAAGCGCCG
4681  CATGCGGGTG TGGGTCGGTG GGTCCTGGTG AGGAGGTGC ACCTGGAGCT GGGAGTGCTG
```

-continued

```
4741  GGGCTCGGGC ATGATCGAGG CGCGGGCGCG CCAGCGGTCG TTGCCCCGGT CGTGGTTCTT

4801  GCCGAGGCGC TCGTCGCCCA GTGCGGAGTG CGCGGCGTCG TAGCCGGTGA CGAGCCAGGC

4861  GAGTACGCCG CTGGGAAAGC GGACGCGGTG CACCGGGCCG GTCTCGCGCA TCCGCTCGTA

4921  GAGGGGGTAC GGGTTGCTCT TGTAGGGGCA GCCCATCAGC GGCACGGGCT CGGGCAGGGC

4981  CTCGGGGGCC GTCCCGGATT CCTGGAGGGT CATGGAAGGT GCTCCTCAGA GGGCGAGTTC

5041  GGGCTGGTAG TGGTCCAGCC ACAGGGCGAG GTCGACGACG CGTTCGAGGC GGAGGCGGTG

5101  GCCCCACTCC AGTTGGCCGG GCGGGGTGTC GAGGCAGGGT TTGAGGCGGG TCTCGTCGGC

5161  GAGGGAGCGG ACGGTGTCGT CGGCGAGGGC GTCGCGGGCC ATGTTCTGCA GGCCGCGGTT

5221  GTAGTCGGGG TGGTGGGTGG CCGGGTAGTG GTTCTTGGGG CGGTGCAGCA CCGAGTCGGG

5281  GGCCAGTCCG GTGCCCGCCG CACGCAGCAG GCTCTTCTCC CGGCCGTCGA AGTTCTTCAG

5341  GGCCCAGGGG GTGGTGAAGG CGTACTCGAC AAGCCGGTGA TCGCAGTAGG GGACGCGCAC

5401  CTCCAGGCCC TGGGCCATGC TCAACCGGTC CTTGCGGTGG AGGAGTTGAC GCAGCCAGCG

5461  GGTGAGCGAG AGGTGCTGCA TCTCGCGCTG CCGGTGCTCG GTGGGCGTCT CGCCGTCGAG

5521  GTGCGGTACG GCGGCCAGGG CGGTGCGATA GGTGTCGTCC CGGAACTCGC CGATGCGCAG

5581  GTCCAGTTCG GGGTTGAGCG GCATCGCGGC CTCGTCTCCG GTCACCAGCA GCCAGGGAAA

5641  GGTGGCGGTG GCGAGCGCCT TGGGGTTGTG GAACCAGGGG TAGCCGCCGA AGACCTCGTC

5701  GGCCGCCTCG CCGGACAGGG CGACCGTGGA GTGCTTCCGG ATCTCCCCGA AGAGGAGGTG

5761  GAGCGAGGTG TCCATGTCGC CGACGCCGAT CGGCGAGTCG CGGGCCACGA CCACGGCCCT

5821  GCGGTGCTCG GGGTCGAGCA GGGCACGCGG GTCCAGTACC ACCGTGCTGT GGTCGGTGCC

5881  GAGGAACGCG CCCGCTTCGG TGGCGTACGG GGTGTCGTGG CCGGTGCGCA GCACATCACC

5941  GGTGAAGCTC TCGGCCTGGT CGCTGTAGTC GACGGCGTAG GAGCGGATAC GCGCGCCCGG

6001  GCCCTCGCGC AGCCGCAGTT CGTCGGCGAG CAGGGCGGTC AGGACGGTGG AGTCGATGCC

6061  GCCCGACAGC AGGGAGCACA GGGGGACGTC GGCCTCGAGC TGGGCGCGGG CGGCGGTGCT

6121  CACCAGGTCG TGCACCCGGG CGATGGTCGC GTCCCGGTCG TCCGGGTGGG CGTCGGCCTC

6181  CAACTGCCAG TAGCGGCGCT CGCGGATGCC GTCCCGGTCC AGGAGGAGCA GACCGCCGGG

6241  CTCGACCTCC CGCACGCCGG ACCACACCGT CGGACCGGTG TTGAACAGCA GGCTGTACGC

6301  CTCGCGCAGC CCGTCCGCGT CCACCCGTGG CCGTATCTCC GGATGGGCGA AGAGCGCCTT

6361  GGGTTCGGAG GCGAAGGCCA GACCGCCGTC CACCTCCGCC AGAAGAGGG GCTTGACGCC

6421  GAGCCGGTCG CGGACCAGGA GCAGCCGCTG GGCCCGCTCG TCCCAGACGG CGAACGCGAA

6481  CATGCCGTCC AGGTGGTCGG CCACCTTCTC GCCCCACTCG GCGTAGCCGC GCAGCACCAC

6541  CTCGGTGTCG CTGCGGGTGC GGAACTCGTG TCCCAGGCCG CTCAGTTGTG AGCGGAGTTC

6601  ATGGTGGTTG TAGATCTCGC CGCTGTAGGT GAGCACGGTG GTCGGGCGT CGGGCCGGTC

6661  GGTCATCGGC TGGACGCCAC CGGCGAGGTC GATGACGCC AGGCGGCGGT GGCCGATCGC

6721  GGCGCGCGGG CCGAGCCAGA CTCCGGCCGC GTCGGGCCG CGCGGGCCCA GGGTGGCGGT

6781  CATGGCCTCG ATGACCGGGG CCTGGGTGCG GGGGTCCTGG TGAAAGGACA CCCAGCCGGT

6841  GATTCCGCAC ATGGGTGCGA CTCCTCGGTG AGGGTGGGGC GGTGGCTCAG CGGGGTGCGG

6901  CGGGCGCCGC GTCGGTGGTC TTCTCGGTGC GGTTCGCGGG ACCGCGGGCG GCCGGGCGA

6961  GCAGCGGTAC GGCGAGGCAG GCGGCGAGGG CGGCGAGGGC GAGCCCCGCC CGTACGCCGT

7021  CGTCCTGGCC CGCCATCCCC CAGGCCGCCG TGGCCAGGGC CGGTCCGAGG GTGAAGCCGA

7081  GGCTGCGGGC GAGCTGGACG GTCGAGCCGA CGGTGGCGGC GCGGTCCGGC GGGGCGGCCC
```

-continued

```
7141  CCATGACCAG GGCCTGGGCC GGGCCGCCGG CCAGGCCCAT GCCGAGTCCG GCCAGGGCGA
7201  GCCGCCAGGC CACGTCGGGA GGGGACCAGC CGTCGCCCAG CGGGACGAGC AGCAGCAGGC
7261  CGACGGTGGT GAGCGCGGCG CCGGTGACCG CGACGGGCCG GGCCCCGTAC CGGTCGGCGA
7321  GCCGTCCGCC GAGCGGGCCC GCCAGCCCCA TGCCGAGGGG GAAGGCGAGC ACCGTCAGGC
7381  CGGTGGTGGT CGCGCTGACG TCCTCGTCAC GCTGGAGGTG GAGGGCGACC ACGTAGTGCA
7441  TGGCGGCGAA ACCCACCGCC AGCCCCAGCA CCGCGCCATG CGCCCGCAGC AGCCCCGCCG
7501  CCCGCAGCAC ACCGGCCACC GGACGGCCGC CCGGACCCCG CAGCCACCAC CACAGCGGCG
7561  GTGCGGCGAC GAGGGCGAGC GGCAGCCAGG CGGGGGTATC GGAGGCCAGG GTCAGGGAGA
7621  GCAGGAGGAT CGTTACACCG GTGGCTATCA GGGCGGTGTC GGCGAGGAAG CGCCGGTCCG
7681  CGCCGCGCAG GCGGCCGTCC CGGGGCATCG CCCGCCACAC CACGGCCAGC GCCAGCAGAC
7741  AGAACGGGAT CTTGACCAGG AAGATCCAGC GCCAGCCCAG GTGGTCCAGG AGCAGACCGC
7801  CGACCGCCGG TCCGGCGACG GCGCCCAGGG GGCCGAGGGT CGCGGGCACG CTCATCGCCC
7861  GCCCGCGCAG CTCGGGCCGC ACCGAGCGGA GCGCCAGCAC CGGCATCAGC ACGAACAGCA
7921  CCGCGCCGCA CGCGCCCTGT CCGATCCGGG CGGCGATCAG CCAGGCCGCC CAGGGGGACG
7981  CGGCGGCAAG CGCGCTGCAC AGCGCGAAGC CACCGGTGGC GACCAGCAGC GCGGGGCGGG
8041  TGCCCACGTC GTCGAGCCAG CGGCCGACAG GCAACAGGAG GGCGACGACG GGGAGTTGGT
8101  AGCCGAGTAC CGCCCACTGG GCGGTCGCCG CCGGTACCCG CAGGCCCTGG GAGATGTCCG
8161  CGAGCGCCAC GTTGACGATG TTCATGTCGA GCATCGCCAC GAACGCCAGC GCGCCCGCCA
8221  CGGCCACCAG GAGCCAGCGG TCATGGACTT CGGGTGGATC CGCCGGCCGC TCGGGTACGT
8281  CCCCGGCCTG ATCCGCACCG GACGCGTCGT CGGTCATGCA CCCCTCCCTC TGGCAGGTCG
8341  GCCGCCGGGC GACGGCCTCG CTCTAGAAGT CGGGCGAACC GCGGAGTGAG TTCCCGGATG
8401  TATCAGGAAA AACGGCTGGA TTTCATGGTT CCCATTTCAT AGTTCCCGGT GGTCGAAGGC
8461  GATCAGCGGG TCCCCGGTCA GCGGATGCTC GACCACGGCC GCACGTACGC CGAACACCTC
8521  GGCCAGCAGG GGCGGTCGCA GCACCTCGCG GGGTGTACCG GAGGCGACCA CGCGACCCTC
8581  GTGCAGGACA TGCAGCCGGT CGCACACGGA GGCGGCGGCG TTGAGGTCAT GCAGCGACAC
8641  CAGGGTCGTA CGGCGTCGGC CGCGCAGCAG GGCGAGGAGT TCGACCTGGT GGCGTACGTC
8701  GAGGTGGTTC GTCGGCTCGT CCAGGACCAG GACGTCCGTC TGCTGGGCGA ACGCACGGGC
8761  CAGCAACACA CGTTGCCGCT CGCCGCCGGA CAGCTCGCTG AAGTGGCGGT CGGTGTGGTC
8821  CCCCATGCCG ACGTCCGCGA GAGCACCCGC GACGATGTCC CGGTCGGCGG CGTCCTCCCC
8881  GGCGAACGCC CGCTTGTAGG GGGTGCGGCC CATGGCGACC ACCTCACGTA CGGTCAGCTC
8941  GAAGTCCCCG CCCCGCTCCT GTGGAGCGC GGCGATGTGC CGGGCCGACC GCGCGGGGCT
9001  CAGCTCGCGG ATGTCGGAGC CGTCGAGCAG CACACGTCCG GCGGCGGGCT TCAGATGCCG
9061  GTACACGGTC CGCAGAAGAG TGGACTTGCC ACTGCCGTTG GCCCCACCA GACCGGTGAT
9121  CTCGCCTTCG GCCGCGATGA GGTGGGCATC GGCCACGACC GTACGTCCGG CGTACGCGAC
9181  CCGCAGGTCC TCGATATCGA TCCTCAACTC CCGCTCCCCA AGCGCCGGTC CAGCAGATAC
9241  AGCAGAGCCG GAGCGCCGAT GAGCGAGGTG ACGACCCCGA CCGGCAGTTC CTGCGTGTCC
9301  ATGGCCGTGC GGCACACGAT GTCGACCACC ACCAGCAGCA GCGCGCCGAA GAGCGCCGAC
9361  ACGGGCAGCA GTCGGCGGTG GTCGCCGCCG ACGACAAGGC GGCAGACGTG GGGGACCATG
9421  AGGGCGACGA AGGCGATGGC CCCGGAGACC GCGACGAGGA CGCCGGTGAG CAGGCTGGTG
9481  ACCGCGAACA GCTCACGGCG CAGCCGTACG ACGTCGATGC CGAGCCCGGC CGCCGTCTCA
```

```
                   -continued
9541   TCGCCCATCA GCAGCGCGTT CAGGCCCCGG GCCCGGGCCT GCAACAGCAG CAGGACCGCC

9601   GGAACCGCCA CCGCAGGGGC GGCCAGCAGC GGCCAGCTCG CCCCGCTCAG GCTGCCCATC

9661   AGCCAGAACA GCACACTGTG GGTCTGCTGC TCGTCCCCGG CCTGGAGAAC GAGGTAGCTG

9721   GTGAAGCCGG ACAGGAACTG CCCGATGGCC ACCCCGGCGA GCACCAGCCT GAGCGGCGCG

9781   AATCCGCCAC CGCGCCGCGC CACCGCCCAG ACGAGAGCGA AGGTGGCCAG GGCTCCCGCG

9841   AAAGCGGCAC CGGACAGACC GAGGCCCAGC GCTCCCCCGC TGCCGAGGCC GAGGACGATG

9901   GCGGCGACGG CACCGAGGGA GGCGCCGTTG GAGACACCCA GGAAGTACGG GTCGGCCAGC

9961   GGGTTGCGGA CGAGCGCCTG CATCGCCGTA CCGACCAGGC CGAGCCCGGC ACCCACCAGG

10021  GCCGCCAACA GGGCGCGGGG CAGGCGCAGT TGCCACACGA TCAGGTCGTT CGTGCCGGGC

10081  CGGGGCGCGT CGCCGCTCAG TCTGCGCCAG ACCACGCTCC ACACCTCACC GGGCGGTATC

10141  GACGTGGAAC CCCAGGCGAC CGCCGCTGTG AGGGCCGCGA GCAACGCGAC CGCCAGGAGC

10201  ACCGCCAGCG GCCCGGCGGG CATGGAGCGC CGGGTGCGCA CACGGGCATC GGTGCCCTTC

10261  CGGCTCACCG TGGTGTCGAG CGCCATCAGC CGATCTTGCC CGGGTGGAGG GCCTTGGCGA

10321  TCTCCTTGAC GGTGTCGGCG TTCTCGACTC CGCCGATGGT GGTCCGCTCG GAGCCGATGC

10381  GCAGGAAGTG GCCCTCCTTG ACGGCCTTCA GGCCCTTGGT GGCGGGGTTC GACTCCAGCC

10441  ACTTCCGCGC CTCGTCGAAC GCCTTCTGGT TCGCCGCCTC GCTGCCCCGA TCGCGGACGC

10501  CCAACTGGAT CCAGTCCGGG TTCCGGGAAA TGACGTCCTC CCAGCCGACC TGCTTGTAGT

10561  CGCCGTCGCA GTCGGCGAAG ACATTGCGGG CACCGGCCAG AGTGATCACC GCGTTGGCGA

10621  CCTGGCGGTT GCAGACGACG GTGGGCTGCT TGGTGCCGGC GTCGTAGTCG AAGAAGAAGT

10681  ACGTCGGCCG CTCGCCCTCC GCCGTCCGGC CGACCGCCTT CCGGACGGCG TCCAGCTTCC

10741  CCTTCATGCC GTCGACGAGT TCCTTCGCCT TCGCGCTGGT GCCAGTGACC GCGCCGAGGG

10801  AGGTGATGTC GGCCTCCACC GCGGACAGGT CGGTCACCGC GCCCTTGTTC CGCGCCGCAC

10861  AGGCGGTGGA CTTGAGGTAG ATGTGCTTGA TTCCGCCGCC CTTGAACTCC TCCTCGGTCG

10921  GCGCGTCGCC CATGCCGCCG CCCATGTTCA TCGAGGCGAA GGTGTCGATG TACAGATCCG

10981  CGCCGGAGCC GAGGAGCTTC TCCTTCGGGA TCACGGACTG CCCGAGCGCC TTCACCTTCC

11041  GCGCCTGCGC GTCGAGTTCA CCGGGCAGCG TTCCCTTGCC GCGCGGGAAG CCGGTGCCGA

11101  TGACGTTGTC ACCGGCGCCG AGGCGCAGCA GCAGTTCCAG GCTGGAGGCG TTGCTGGTGA

11161  CGATCTTCTC GGGGGCCTTG AGAACGTGG TCTTGGCGTC CATGCAATCG GTGACGGTGA

11221  CCGGGTAGTG GCCGGTGGCC GACTTCTCGT CGGCGGGGCC CGCCTTGTCA CCGCCGCCAC

11281  TGCCGCCTCC GTCACCACAG CCCGCCACGA GGAGGCCACC CAGCACCGCG GCCGTCGTAC

11341  CCCACCACAC ACGAGAACGC ATCGAAACTC TCCTGGATCC ACTTGATACC CGGGTTGCCC

11401  CGGATCAGTA GTCGTGGCGG ATACGGCATC GGTTCCCGCT CAGTGGGAGC CGGTGAGAGT

11461  CTCTGAACTT GAAGGGCAGA CTAGGTACGT GGCGTCGGTG ACGCATGGAG TCGACAGGAG

11521  AGAACGTGCA CCGCAAACTC CGCCTGCCTC TGGGGCGGCT GGCAGCCCTC GTCTGCACAT

11581  CTGTCATCGC CGTCACGGGC TGTGGCGGCG GTGACGGCGA ATCCGGGGCT CCGGAGCCGA

11641  CCTCGAAGCC GACCGCCGGC GCCGGGCTCA TACCTGTCGC CCAAGCCTGC GGCGGCCTGT

11701  TCGACGAGGC CATCGCGAAA GAGGCCCGGG AGCCGAACGG GCCCAGCGAG GTCTATCCGG

11761  TCGAGACCGA GAGCACCGGC CACGTGGCGA AGACGCTGCG GAAGGAGTCG GCCAGGAGGA

11821  GCACGCCCGA GGACCTCTGT ACCTTGACGG ACAAGGCCGA GGGGAAGGAG CTGCTCGCCC

11881  TCACCGTGGC CTGGACTCCC CACTCACTCC CGTCGGGCCG GTCGGTGCGC TACACGACCA
```

-continued

```
11941  CCGTCGGTCC GGAGGACGCC GGCAGGCTCC TGGTCGCGTG TGACATCGAC AGCGGAAGGG
12001  GGACGGAGTC GGGCGGGGGT CGTTCCCTGG AGTTCGCCCT GCGCGACCAC TTCACCGTCA
12061  GCGACCACTC CCACGCCAAA CTGCTCATCG CCTCGGCGAA GAGGACAACG TCGCAGCTCG
12121  ACTGCCGGGA AGCGCCCGAA TACCCCGACC CGAAGGTTGT GGCACCGCCA CCGAAGCCCG
12181  GGCTGCGGTA GCGCGGTCCT TCCACCCTGC CGCAGATGAT GGCGGTTTAA TCGAGTCATG
12241  ATCTACCACG TCGTACCGCT TGCCGAGTGG AACACCGCTC CCGACCGCCC CTACAGCCCC
12301  GCATCCCTCA CGGAGGACGG TTTCATCCAC TGCTCCCCCG ACGAGGCGAC CACGCTGGCC
12361  GTCGTCAACG CCTTCTACCG CGATGCGCCG AGGCCGCTGC TGGCGCTGCT CCTCGACGAG
12421  GACCGGCTCA CCGCGAAATG CGAATGGGAG GCCGCGAACC CCGCCCCGCC GCCCGGCGTC
12481  GCCGAGAACT GCCTGTTTCC CCATGTCTTC GGGCCGCTCA ACCGCGAGGC GGTGGCGCGG
12541  ATCCAGGAGA TCGTATGGGA CTCGGAGAGC CGGGCGGTGG GGTTGACGGA TGTGCGCCCA
12601  CGCTGACGAC GAGGGCCGTC AGAGTGGAGC GAGGCGGGCC TTGAGCAGGC AGAACTCATT
12661  GCCTTCGGGA TCGGCGAGGA CGTGCCACTC CTCCTCCCCG GTCTGGCCGA TGTCGGCCCG
12721  CCGTGCACCG AGCTTCAGGA GGCGTTCGAG CTCGGCGTCC TGATCGCGGT CGGTGGCGTT
12781  GACATCGATG TGCAGCCGGG ATTTCCCGGG CTCCGGCTCG TCCCTGCGGC TGAGGATGAT
12841  CGTCGGCTGC GGACCGCCGA ACCCTTCGCG CGGCCCGATC TCAGGGGTTC CGTCGTCCTC
12901  GCGATCGAGC ACCACGAAGT CCAGGACCTC GCACCAGAAT CGCGCCAGCA CCTCGGGGTC
12961  GCGGCAACCG AGCACGAGTT CACTGATACG ACATGCCATT GACGAAACCT ACTCTCAGCG
13021  TGGGTACTGC CGGGGTGGCC GCGCGCAGAT CTCAGAGGCT TCCCGCAGTG AGGACTCTCG
13081  GGACCGTACC GGGCGAGGCG AGCAGTGGCG AATGGATTTC AGGCCCTCGC CTGCCTGTCT
13141  CCCTCGGGAC GCTCGCCGGG GCCGGAGCCG GAGCTGGGAC TGAGGCTGGG ACTGACGGCC
13201  TCCGCAGCCG AGTGGGCGCC TTCGGCCCCG TATCGGCGCA GCAGCCACAG GCCATACGCG
13261  GCCTGGAAGA CGAACACGCT CACCTGCCAC CAGTCCGGGG CCGAGCCCGG CGAGCGGATC
13321  TGGAAGAAGT CGTCGAGCCC ATGGACGACG ACCATCGGCC AGACCGAGCC GATCGCGTAA
13381  CGCAGACCCG CACAGGTGAA GCCGAAGAGA CCGGCGGACA GCATCTGCCA CAGCGTGTCG
13441  TCGAGCGGAT CGCCGAAGAA CAGGAAGTTC TGGAGGTGTC CTGCTCCGAA TAAGACGGCG
13501  ACGCCGACGG TCGCGCGGAT CGGACCGAGC GGGTTGAGTG CCTGCTGGAC GAGGCCCCTG
13561  CTGTAGATCT CCTCGTTGAT GCCGACCCAC AGCAGCGAAA CCAGGCCGCT GACGATGACC
13621  GTCGCACTGC CGTCGAGACC CGCCACGGTG TACGAACAGG CAATGAGCAG CATCGGCGCG
13681  GCCGGCCACC AGCGTCGTGG ACGGCCGAGT ACGGCCACCG CGGAGCGGCG CAGCCAGCCC
13741  CACCGCCACA GCACGAGCCA CACCCCGCG GCACAGATCG CGTTGACCAG GGTGGCGCCG
13801  AGATCCGGAT ACCACGAGGG CGCCAGCGGA GGCAGGATCA CCTCGGCGAA CAGCAGCAGC
13861  ACCGCATGCC ATGCGAAGGT CAACTCCACC GCGCCCCAGA GCGGATGACG GATGACGTGG
13921  CCTTTCCACC GCTTCATCAC GAGACCGAGC GTAGCCGCGG ACAGGACTTC GTGGCAGGCG
13981  GCCGCACAGC CCAGAAGCTG GGCCTGCTCG GTCGGCGTCA GTTCGTGGCG GTTGCCACCG
14041  TCCGGCTCTC ATCGGCCGTC GCGGGCCTGG GATTCAGCAA CCGCTCGGCA AGCTCACCGA
14101  AGAGAAGACC GAACCCACCC CACAGAATCA CCTGCATGGC CAGCGCGGAC AACCGGAACC
14161  GCCACAACAC CGTGGCGGGA AAGTCCCCCG GCACCTCATT GACCACAGGC AGGAAGGCAA
14221  ACGCCACCCC GATCACCACG GCGAACGCCG CCACCGCCAC CACGGTCGCA TACCAGGTAC
14281  CCAACCTCGG CACGAGCCGC TTGCCCACCA TCGTGGCCCC CACCGCCAGG AGCACACTGA
```

-continued

```
14341 GCACCATCAT CAGGAAGTAC AGCGCCGTAC GCTTACCGAT CGTGTCGGCG TTACCGACCG
14401 CGGGCGGATT GGCCGGATAC TTCACGAACG GCACCACATA CACCGCCAGC AGCGCACACC
14461 CCGACAGCAA CAGCGCGGTG GCCCCCGGCG TGAAACGGCC GACACGGCCC AGGGCCACGC
14521 AATACGCCAG AGCGGCGATA CCACCGAAGG CGATCCCATA GACCAGGACA CCGGTGGCCA
14581 GCCCGGCCGT GGACTGCACA CCACGCGAAA CCAGCTCGAC CTCATGCTCA TGCGCGGGAG
14641 CGTGAGCCCC CTCGAAGCTG ATCGCACGGT CCACGTTCGG CTCACCGAGG AAATAGGCGG
14701 CGACCAGGGC CGGCACACCG GCCCCCAGAC CCGCGAGCAT GCCCCGGATC AGCAGATTTC
14761 TCACCATTGC GGAGTTCATG ACTATGCGGC GTCCCTCACA TCAGTGGCAG GGGAAACCGA
14821 GCAGATGACG GGCGTCATGC ACCCACTCAT GAACGTTCTC ACCGGAGACA ACGGCGGTGG
14881 CGCCCTGCTC GGCGCCGACG AAATACAGCA GGACCAGCAT CAGGATGCCG AAGAAGACCG
14941 CCCAGGGAGC TATCGCCTTC AGCGGCAGCG TGGCGGGCAG TTCGGGGGTG GTGGCAGTGG
15001 GCTGCGCGAC ATGCTGCGCC ATGACCAGGC CCTCCTTAAG GGAGTTCGCG TCCCATCTCG
15061 GTGGTGCACA GGACGACGGC TACGGGTCTG ACTCACCACA GATCCCGTCC GGGACCCCTG
15121 GTTCACAGTG GCGCGACCGT GCCGGATTCC CACCGGCTTC CGTCTTACCG TCGTCGATAT
15181 CGCACCGACC GTACCGCGTG TCGGGTTCAT GGCCAAGACC GCCCACCTGG CGAGACGCTG
15241 CGCCGGGACG TCCTGAGGAC GGTGCGGGAG CCGGGGCCTG CCTCGGGCAG GCCCTAAGGT
15301 CGCGGCATGC GCATCGTCTC CCTGCTGCCC GCCGCGACCG ACATCGTCAC CGAACTCGGA
15361 CTCGCCGAGC ACCTGGTCGG CCGGACGCAC GAATGCGACT GGCCACCGCG GACCGTGGCG
15421 TCCGTTCCCG TGGTCACCGG AGCCGACCTC GACCAGAACA CCCTCACCAG CCGGGAGATC
15481 TCCGACGCGG TCGGCGGATC GACGCACTCC GGGTCGTCCC TCTACACCCT CGACACCGAA
15541 GCGCTCGCGG CCCTGGGCCC CGACGTGGTG CTCACCCAGG ATCTGTGCGA GGTGTGCGCC
15601 GTCTCGTACG AGAGGGTCAG CCGGGCCGTC CGGCTGCTCG ACGCCGACAC CCGCGTCCTC
15661 AGCCTGGAGC CACGCACGCT CGACGATGTA CTGGACTGCC TGGTCACCGT GGGTGAGCTG
15721 CTCGGCGTGC GCGAGCGCGC CGAGCAGCGC CGGGCCGAGC TGCACGACCG CCTCGAGCGG
15781 ATCCGCCGGT CGGTCGCGGG CCGCGCCCGG CCCCGGGTCG TGGCGATCGA ATGGCTCGAC
15841 CCGCTGTGGC CGCCGGACA CTGGGTACCC GACCAGATCA GCGCCGCGGG CGGCGCACCG
15901 CTGCTCGCCG TGTCCGGCGA GCACACCAAG CCGATGACCT GGGAATCGGT GCGCGCCGCC
15961 CGCCCGGAGG TGGTGCTGGT CCTGCCGTGT GGCTTCCCGC CGGAACGGAC CCTGCGCGAG
16021 ACGGAACTCC TCACCCGCCT CCCGGGCTGG ACGGAACTGC CGCCGTACG GGCCGGGCGG
16081 GTCTGGGTGC TGGACGGGCC GGCCTACTTC AACCGCCCGG GCCCTCGTGT GGTGCGCGGA
16141 GCGGAAGTAC TCGCCCACGT CCTGCACGGT GTACGGGCCG GGACCGCGGT GACGGCGGAC
16201 GAGGCACACC CGTTCCCGGG CGCCCCCGGC CGGTGACGCG GTTCCGTCCG CCCAAAAGCC
16261 ACGGCAAGTG CTCGGCGCTT CTTGCATACG ATGCGCTGAT GCATAAGATG CGCACCAGTC
16321 TTGGCTCCCT CTCGGACGAC ACCCCATGAC GGACCTGATC CGCCGCGCCC TGACCGGCCG
16381 AGCCGCCCGG ACGGCGCCGA CCCCGAAGTC CCCGCGTGAG CGCACCTGGA GGCATCTGTC
16441 TCCGCTTCTG CGGCTGCTGA TCCTGACCCA ACTCGCCTTC AACGTCGGCT TCTTCGCGGT
16501 CCTGCCCTTC CTCGCCGAGC ACCTGGGCAC CGCGATCGGC ATGGCGGGAT GGATGGTCGG
16561 ATTCGTCCTC GGTCTGCGGA CCTTCAGCCA GCAGGGGCTG TTCGTGGTCG GCGGCTGGCT
16621 GGTGGACCGC TACGCGCTGC GCCCCGTCGT GCTGACCGGC TGTGCCGCGC GGATCGCGGG
16681 CTTCGTCTGG CTCGGCTACG CGGAGCGGAC CTGGGCGGTG ATCGGCGCGG TGCTGCTGAT
```

-continued

```
16741  CGGCTTCGCC GCCGCGCTGT TCTCCCCCGC GGTGGAATCC GAAGTGGCCC GGCAGGCGGT
16801  GGCCTGGGAG GGGGAGGGCC ACGGTTCGCG CACCCGGGTC CTGGCCCTGT TCACCGTCTC
16861  CGGCCAGGCC GGTACCTTCG TCGGTCCCCT CCTCGGCGGT TTGCTGCTCG GCGTGGAGTT
16921  CCGCGCCGCG TGCCTCGCCG GAGCCGGGGT CTTCGTCCTC GTCCTCGCCG GCACGCCTG
16981  GCTGATGCCG CGGCACATCC CGGGCCGGGT CCGTAACCGG GAGCAGGGCG GCGTCCGCGC
17041  GATGGTGCGC AACCGGCGAT TCCTCGCCCT GTGCTGCGCA TACGGCACCT ATCTGCTCGC
17101  CTACAACCAG CTCTACCTGG CCCTCCCGGC CGAAGTGGAG CGCGCGGCGG GCTCCCAGGT
17161  GCCGCTGTCG TGGCTGTTCG CCCTGTCTTC CCTGCTGGTC GTCTTCGCCC AGCTCCCGGT
17221  CACCCACTGG GCGGGCAACC GGCTCGATCT GCGCCGCTCG ATGACCATCG GCTGCTCCT
17281  CATCGCCGCC GGTTTCGCGG TCGTGGCCGC CGCGCGCCCG GCCGCCTGGA CGGGCGCCGT
17341  CGGATTGCTG CCCGCCGCGG GCTACGTCGT GCTGCTCACC CTCGGCCAGA TGCTGGTCGT
17401  CCCGGCCGCC CGCGCCTGGG TGCCCGACCT CGCCGAGGAC GGTCGGCTCG GCCTCTACAC
17461  CGGGGCGCTG TCGTCCGTCT CGGGCCTGAT CGTCCTCATC GGCAGCTCGG CCACCGGCTC
17521  CCTGCTCGAC CTGGGCCTTC CGCCCGCCGC CCGCTGGCTC GTCCTCGCCG CCGTCCCGGC
17581  CCTCGCGGTG ACACTGCTGC CCCGCCGCCC GGATCAGCCC AGGGTGAGCA GCTCCTCGTA
17641  GAAGCCGCCG AACTCGCGTT CCCGGTCGAC GAGGTGGATC TCCAGGATCC AGTGGCAGCG
17701  GCGTCCGGCC TTGTCGGTGT GCCGCAGCGG GGTGTCGTTG TCGGGCGTGA TGTACGACTC
17761  CACGCGCGCG CCGTCGATCG TCTCGTGCGG GAACTCCCCG ACCAGGTGGC CGGCGTGCCA
17821  GCCGCCCAGC TCCCAGCCGG CCCCGGCGGC CAGCCGGTCC ACCTCGGCGT GCCGCCGCTT
17881  CCCGGTGATC TCCGGGTCGC TTTCGAAGAA CCGCTTGCCC GCGTCGAAGA CCTTGGGCAG
17941  ATCGTCCCGC AGCCGCCGCT TGACCGGGTC GTCGCCGAGG ACGAAGGTCC GGCCGAAGTC
18001  GGCCTCGTAC TCTTCGAAGA TCGGTCCGAG GTCGGCGAGC ACGATGTCGT CCGTGCCGAT
18061  CACCCGGTCC GGCGGATTCT CCCGGTACGG CAGGAGCGTG TTCGGCCCCG AGCGCACGAT
18121  CCGCTTGTGC CAGTGCCGGG TCGTGCCGAA CATCTCGTTC GCCAGGTCCC GGATCCGGTC
18181  GCTGACCGCC CGCTCCCCCT CGCCCGGCGC CACCAGCCCG CGCCCCTGGA TCTCCGCGAA
18241  GAGCCGTACG GCCTTCGCCT GGGCATCCAG CAACCGTGCC GCGCGCGCGG GTTCGTCGTC
18301  CGCCATGGGC CCGACGGTAG GCCGCTAGAT CGTTTCCCGG CAACCGGATG AGGCAGTCCT
18361  CAGTCGGCGC GGCCGGTCGC CGCCACCGTC ACACCCAGGC CGATCATCGC GAGGCCGCCC
18421  GCCCCGCCGA CCATCGAGAG GCGGCGGTCC GAGCGGGCGA ACCAGGAGCG GGCCGCCGAG
18481  GCGCCCAGGC CCCACAAGGT GTCCGTGACC AGGCCGATGG TGACCGGGAC CAGGCCCAGC
18541  ACCATCATCT GGACGGGAAC ATGACCCGCC GAGTGGTCGA CGAACTGCGG CAGCACCGCC
18601  GCGAAGAAGA CGATGCCCTT CGGGTTGGTG ACCCCCACCA AAATGCCGTC CAGGATCGAA
18661  CGCAGATCAC CACGCCGCTC ATCGGCCGGA GCGTCCATGT TCGCCACGCG CATCTCCCTG
18721  CGGTGCCGGA ACGCCTGCAC ACCCAGGTAG ACGAGATACG CCGCTCCTGC CAGCTTCACG
18781  CCCATGAACA GCGCCACCGA GCTCTCCACC AGCGCGCCGA GGCCCCACGC CACGGCGACC
18841  ACCAGGGCGT AGCAGCCGAT CACATTGCCG AGGACCGTCG CGAGCGCCGT GCCGCGGCCG
18901  TGGGCGAGGG CCCTGCCGAC CACGAACAGC ACACTCGGCC CCGGGATCAC GATCACCAAG
18961  AGCGACATCG CCGCGAACGT GAGAACACTC TCCGTGGACA CCACGTGTCC GCCACCTCCT
19021  GAATCGCTCC GTCCAGGGGA CATACAAACA GATGACGGAA CGCCCGCTCC AGCCTCAGGC
19081  ACCCGCGGAC AGTGGCCGCT CCCCTACTTG GTCACGGAAT AGGAGTGCGC TCCGGTTCCG
```

-continued

```
19141  GCGAGTGCTC CCCCGTCCAC GATCAGGTAC TCGTCGCGGA TGGGCCGCCC CATGGGCCAG
19201  GACTCCAGGA TCTCGCGGGT GCCCGCCGCG TAACGGGCCT GCGCGGACAG GGTGGAGCCG
19261  GAGATGTGCG GGGTCATCCC GTGGTGCGGC ATGGTGCGCC AGGGGTCGTC GGCGGGGGCG
19321  GGCTGCGGGT ACCAGACGTC GCCCGCGTAG CCCGCCAACT GGCCGCTGCG CAGGGCACGG
19381  TCGACGGCGT CCCGGTCCAC GATCCGGGCC CGGGCCGTGT TGATCAGGTA CGCGCCGCGC
19441  TTCATCGTGG CGAGCAGTTC GTCCCCGAAC AGGCCCTCGG TCTCGGGGTG CAGCGGCGCG
19501  TTGATGGCCG GGCCACGCAG TCCGCGATGT TCCAGCCGCC GTCGAGAACG ACCTGGTGGG
19561  AGGGCAGATA GTTCCGCACC AGGGACAGGG TCATCATCAC CACGTGCTCG GCGACGCTGA
19621  TGCTGTTGGA GTACCTCACC TCGGCGACCG TCACCCCGTG TGCGATCGCC GCGTCGAGGT
19681  CGACGTGGTC GGAGCCGATG CCCGCGGTGA TGGCGAGCTT CAGGTTCTTG GCGACGGCGA
19741  TGCGCTCGGA CGTCAGGTAC GCGGGCCAGA ACGGCTGCGA GATCACGACA TCGGCATCGG
19801  GCGGCTCTCG GTCGAACACC GAGCCGTCGC CGTCCTTGTC GGAGGTGACG TGGGCAGGTG
19861  CGGTTCACCA TCCTCGCCGC TGAACGGCCT GGTCAAAGCG AATCTCGCTA TGCTCGTATA
19921  GTCGGCGGCT ATCGCCCGTG TCCGTTGAGG CAGGTGTGCA GGCGCTCGTC CAGCGCCTGC
19981  CGTACGTCGG CCTCCCGGGC CACCGTGAGC AGCGCCCCGG CGAGGACGGA GGGCGGGTCG
20041  TCGGGCCGG TGACCAGCCC GACCCGCGGC CCGTGCACGG GCCCCTCCAG GGGCACCACC
20101  CGCATGCCCT CCGGTACGCC GAACATATGC AGCCAGGCGT GCGAGATCAC GCTGGACCAG
20161  CGGCCGCCGG GCAGGTGGGC GTACAGCCCG GCGACGCTGT CCGACTCGAT GGCGGGCGTG
20221  ACGGTGGCGC CGTCGGCGGC GAAGCACTCG TCCATGATGC GGCGGTTGCG CATCCGCGGG
20281  CCGAGCAGGC ACAGGGGGAG GTCGGCCGCC TGCGCCCAGC GGGCCGTGGC CGCGGTGGCG
20341  AGCGAGCCGT CGACGGGTGT GACGTATCGC TCCTCGTACA GCGGGAGCCG GCGCAGGCCG
20401  CCCAGGGAGT CGTCGTCGAG GTAGGTCATC GCCGCGTCCA GTTCGAACTC GGCCAGCCCG
20461  TGGGTGATGT CGATCGAGGA CAGTGACTCG ATGCTCACCC GGGCCCTCGG GTGGCTTTCG
20521  CAGAAGGGGC TGGTGAGGAG GGACGCGGCG GGCATCGCGG TGGGGATCAC TCCCAGGCGG
20581  AGGGTACCGG TCAGGCCGTC GCCCAACGCC GACAGCTCCT GCCGCAGCCC GTCCCGCTCG
20641  GCGAGGATGC GGTGTGCCCA CGCCAGCACC ACCTCGCCCT CCGGGGTGAG CCCCTCGTAC
20701  CGTCGTCCCC TGCGCACGAT CGGCACACCG AGTTCGTGTT CAAGGCGGCG GATGGCGGCG
20761  GCCAGCGACG GCTGGGACAC ATAGCAGGCG GCCGCCGCGC GGACGAAGTG GCGCTCGCGG
20821  GCGAGGGCGA CCAGGTATTC CAACTGGCGC AGTTGCATGC GTGACCTCCA CGACGCGTCC
20881  CGTCCCGAGG GCGCGGCGTA CAGCATCGTG CAGGCTGCGG CTGTCCGCGA GGTGGTCGAC
20941  GGGTGGGGAG TTCGGTGTCG CTCACCAGCA CACGGCCGGG ACCCGCATAA AGGGCCCCGG
21001  CCGGTGAATC GGACGACCTT CGAGACGGGT CCGGCCAGTG ACGGTGACCC GAACGAAGCT
21061  GCTTACGACT GAGCGCCGGA CGCGGGCGCG TTGAGGTTCT CGTGGACCGC GCCGGCGATG
21121  CCCTCGATGT TGGCGATGCC GTCGTCCATC GTGGCGTTGT CCTGCGAGAG CACCGTGATC
21181  GTGTAGTCGT GGTCGCCGCC GGTGAAGGCG CCGAGGCTGT GCACCCGCCA GCCGTTGGTG
21241  GCCCGCTCCA GCCACCCGTT CTTCACATGC ACCTGGGCGT CGCTCGGCGC ACCGGCCGGG
21301  GTGCCCCAGC GCTGCGAGGG GATGACCTCG CCCGTCAGCT TGAGGATGTA GGCGCGGGAG
21361  TCATCGCTGA GCACCGGGTT GCTGTGGGTC ACCAGTTGGA GGAGCTTTTC CTCGTCGTTC
21421  GCGGTGATCT GGGTGAGCCC CCAGTGGCCC TCGCTGTCGA GGGTGGTGTT GGTCATCCCC
21481  GCGGCGTGCA GGAACCCGTT GATCTTGTCG GCCCCGAGCT GCTTCCACAG CGCGGTGGTG
```

-continued

```
21541  GCGTCGTTGT CCGACTTCGT GATCATGGCG GTGGCATGGT CCTTCTCCTC CTGCGTCAGG

21601  GCGCGATCGT CCTTCTGCGC GTCCCACAGC AGGGTGCCGA GCACGGTCAC CTTGACCGTG

21661  CTCGCGGAGT CGAAGTGCCG GTCCGCGTCC AGAGTCCAGG TGGTGTTCGT GGTGCGGTCG

21721  TGGAGGCTGA TCGCCGTGGT GGCGGCGGAG CCCTCCAGTG CCGAGTTGAT GTCCTCGGAG

21781  AGCTTGTCGG CGAGTTCCGG CCGGTCCGAG GTGCAGATCG CCGCCTGCGG GGTGGCCGCG

21841  TGTGCCGACC CCACCGAGGC GATCGTCGGC ACGAGCACCC CTGCGGCCAG CGCCGCCTTT

21901  GTCGCCAGGG TGCTACGGGG AGGCTGGGTT ATTCGTCGGT GTCGACCCAT GGTGGGCTTG

21961  TCCATTCGTT CGTGGGGCAG TTGGACACGC GGTGCCTTCG CTCCGTCGCG AAGCCATCCG

22021  GGTGCTCCGA CCCTGGATGA CGAGCCGGAG GCAGGTGAGG TTCACGAACG CGTCCAAGTC

22081  TCACAAGATC GCTCCACAAT AGGCACCGCG CCCGGGCGGA CCGGGCGCGG TCCGGCGGAC

22141  GAGCCGGGAC CCGGTCAGCG CCGAATGGCC CTGAGGAAGT CTCCGAGGGC TCGGGCTACG

22201  GCGCCGGGGG CTTCCGCGGG GAGCAGGTGG CCGGCGTCAG GGACGGTCGT CAGGGTCGCG

22261  TGCGGGATGT GGGGCAAGAG GTGTTCGCGC AGGATGTGCG GCGGCTCCAC CATGTCGTTC

22321  TCCGCGGCAA GCACCGTCAC CGGGACCTCG ATACGCCGTG TGGCATCGGT GATGTCCCGC

22381  GCGATTCCGT GCAGGGGCCA CTCCTGCCGG GCCTCGGCGC CGGAGGCGAG GCTGTCGCGC

22441  TCCGCGGTGG CCCGCACCGT CTCGGGCAGC GGTGTGGCGG TCAGGACATG GTCGAGGGCG

22501  TGCGCCACCG TCTCGGCCGA GTCGTAGGCG TGTGACAGGC CCTGTCGGTA CTCCTCGGTC

22561  ACCATGGCGG GTGGCTGGGG CGGTGCGGGC CCGACGAGCA CCAGACCGGC CAGACCGGCC

22621  GGTCGGCGGG CCGCGACGAG CTGGCTCGCC TTGCCACCCA TCGAGTGGCC GACGAGGACG

22681  AACGGCCCCG ATACCCGCTC CTCGACCACA CGGACGAGAT CGTCGGCGAG CTGGTCGAGG

22741  TGATAGGGCC CGGGCAGCGC CCGCGACGTG CCCCAGCCGC GCTGGTCGAA GCGGACCGTC

22801  GCCTGCCCGG GCGGCAGGTG GCCGAGCACA CCGTTCCAGG TGTCGGCGGA GCCGCCCCAG

22861  TAGTGGGCGA ACACCAGCGT CGGACCGGTA TCGCCCCCGA CTCGCACATC GAGCGATCCG

22921  CCCGCCACGG GAACTCTCAT TGTCATTTCC ATCATCTTCG CGCCTTCCCT CTCGGCCGCG

22981  GAAGGCGACT CCGTCGTCCT GCCGCAGCTC GGAACCAGTA ACCTGACCTG CCGATCAGGC

23041  GCGGAATCGA CCGTAGGCGA GGGAGTGTCC ACTCCTTGGC GGAAAGGAAC ACGTTCATTG

23101  TGGAAAACGG ACACAGTGCG GTGCGGCAAC TGCGCTATCT GCCTGCCGTG GGATCGGCGT

23161  ACGGGGTGGA GGTCCTGGAT TTCGCCGCGC TGCGTTCGAT GGACACCCAG CGCCGTCGTA

23221  CCCCAGCCGCA GCGCCCCGAC TTCCATGTGT TCGCGCTGGT CGGCTCCGGA ACCGGCAGCC

23281  ATGAAGCGGA CTTCCACAAC TACCGGCTGG GGGAAGGCGG CGCCGTGTGG ATCCGGCCGG

23341  GCATGGTGCA CCGCTGGAGC GATATCGACG CCTGCGACGG CCCGCTGATC CTGTTCCGGC

23401  CCGGTTTCCT TTCCGGCTTC ACGGCGGCAG AGGCCACCAC ACCGGCGTGC TGGCATCTGG

23461  ACCGGCAGCG GCTGCCCCTC GCCCTGCTCG CGGCCGAACA CTCGGCCGC GAGCACAGCA

23521  CGGCAGTGCA CACACCACGC CTGGCATCCC CCGCCCTGCT CTCCCACCTG CTGGCGGCGC

23581  TGATCCTGCG CGCACTCCCG GGCACACCGC CCTCGGCCGA GGCGGCAAGA CCCGGCAGCC

23641  CGCCAACCGA AGTGTTCCGG GTCTATCGGG CCACCGTCGA AGAGCGCTTC GCCGAATGGC

23701  ACCAGGTGGC CGACTACGCA CGGGCGTTGG GCTACGACGT ACGCACCCTC ACCCGGGCAA

23761  CGCGCGCCGC CACCGGCACG GGCGCCAAGA CCTTTCTCGA CCAGCGCATC CTGCTGGAGG

23821  CGAAACGGCT CCTCGCCCAC ACCGATCTGC CGGTCAGCGG CTGCGGCCGA CGCCTCGGCT

23881  TCCGGGACGT CGCCAACTTC ACCACGTTCT CCGGCGCCA GACCGGCCTG CCCCCCGCCG
```

```
                                                          -continued
23941  CGTGGCGCGC CGCGTACACC ACCGGCGGCA CACGCGGCGT CTGACTCGCC CTCGGCGGCC

24001  GGGGTCCGGA GAGTCACTGA TGTGCGGGGG CAGGTTCACT GTTGCGGGGG CAGGTGCCGC

24061  AATCCGTTCT CCAGCAGGGC GAAGGCGTGC TCCATGTCGG CCACGGCACC CGCGTAGCGC

24121  TCGTCCGCCG CCTCCCCGTA CGCCACACGT TCGGCGTTGT CGTCTGCCAA CGCCCAGTGG

24181  ACCGCGACGA TTTGCACCCC GGCGAGCCGC GCGGTGAGTT CCGGAATGTC CGCCGTTTCC

24241  CGCAGTGCCT CGGTCAGGGC GTGCTCGGCG CCGGTCTTGA ACCGTGCCAT CCGGGCCACC

24301  AGCCACCGCG CGTCGAGGAT CATGGCCTGC AGCCTGCGCA CCGCGGGATG GTCATTGAGC

24361  CCGGTGATCG GATCCCGCTC GCGCAGCCCC TTGAGAAAGT GCTCGCGCAG TGCGGTCAGT

24421  GGGTCGGTGC CCGGCGGGCG GGCCCGTACG ACGCGTGCGG ATTCGGTCTC GTGGTCGGCC

24481  AGGCGCTCCA CCACGACCTC TTCCTTGGTC GGGAAGTAGG CGAAGAGGGT CGCGTTGGAC

24541  ACCTCGGCCG CCTCCCCCAC CTGGGCCACC GAGACCTGGT TGAAGCCGTG TTCGAGAAAC

24601  AGCGAGATCG CCGCGTCGCA GATCGCCGCG TGGGTCCGCT GCTTCTTTCG TTCCCGTAGT

24661  CCTGGCTTGC CGTCCACGGC GTCCACGGTA ACAGAAAACT GCCCCTGGTA AATTTCTGCA

24721  CCGGGTATAT ATTTACCCTC GGTGAGCTGA TCCGGAGCGT TGAGATGAGA TGGAGTGACG

24781  GTGTTGACGG AGAGCACCAC CGAGGTCGTT GTCGCGGGCG CGGGCCCGAC CGGGCTGATG

24841  CTGGCGTACG AACTGGCTCT GGCCGGGGTC GAGACCCTGG TGCTGGAGAA GCTGCCAGAG

24901  CGGATCCACC AGGTCAAGGG CGGCACGATT CAGCCCCGCA CCGCCGAACT GCTGGAATCC

24961  CGCGGCCTGC TGGAGCCGCT GCTGCGGCGG GCCATCGCGC GTGGTCCGAT GGGCGGCCAT

25021  TTCGCGGCCC TGCCCGTGCC CCTGGACTGC ACCCCCTGGC GGACCGAGCA CCCCTTTCCG

25081  ATCGGGATCC CTCAGTGGGA GATCGAGGAG GTCGTCGAAG AGCGGGCGAC CGCCGCCGGC

25141  GCGCGGGTAC TGCGCGGCGC CGCCGTCTCA GGGGTCGCGC CGGATGACGA TGGTGTGGTC

25201  GTCACGGCGG ACGGTCTGCG GGCGCGGGCT CACTACCTGG TGGCGTGCGA CGGCGGCCAC

25261  AGTACGGTGC GGAAACTGCT CGGGCTGCCG TTTCCCGGCC GGGCCGGAAC GCATCAGGCG

25321  GTGCTGGCCG ATATCCGGCT GTCCGCCGTT TCCTCGCTGG TGCCGCGGCA GGCGGGGCAT

25381  ATGAGCACCC TGACCCGTCA GGCGCGGGGC TACTGGTCCA TGCTGGTCCC TGTCGGCGGC

25441  GACCGGTACC GGTTCACCTT CGGGCATGCG GACCAGGCGG ACACCGCCCG CGACACCGCC

25501  GTCACCCACG AGGAGATCGC GGCCGCGCTG GAGGCCGTGT ACGGCCCCGA GACCACCCTC

25561  GGCGGCGTGG ACAACTCCTC GCGGTTCTCC GATGCCACAC GGCAACTGGA GCACTACCGC

25621  ACGGGCCGTG TCCTGTTCGC CGGGGACGCC GCGCATATCC ACCCCCCGCT GGGCGCCCAG

25681  GGCCTCAACC TCGGCGTACA GGACGCGCTC AACCTCGGGT GGAAACTGGC CGCGGTCCTC

25741  CAGGACCGGG CGCCGAGCGG GTTGCTGGAC AGCTACCACG CCGAACGGCA TCCGGTCGCG

25801  GCCCAGGTCC TGCATCACAC CTCGGCGCAG CGCGTCCTGA CGAGTCCGAA CCCGAGCGAG

25861  GACGTGGCCG CCCTGCGCGA CATCATCACC GACCTGCTGC CGGTGCCCGA CACCAACCGC

25291  CATCTCGCGG GGCTGATGTC CGGTGTCTCG CTGCGCTACG ACCTGCCAGG CGATCACCCG

25981  CTCACCGGGC AGCGCATGCC GGACGCCGAT CTGGTGACCG AGACCGGCAC CACCCGGCTG

26041  TCGACACTGT TCGGCTCCGG GCACGCCGTC CTGCTCGACC TGGCCGGAGC CGTCCCGGCC

26101  GACCTCCCGC TCCCGCCACG AGTCGACCTC GTCCGCGCCA CATGCGCCGA CGATCTGGGC

26161  GCCGCCGCCC TGCTCATCCG CCCCGACGGC TATGTCTGCT GGGCTACGGA CACCACCGCC

26221  GCCTGCGGCG ACACCCTGCT GGCCGCGCTC ACCGGCGACC TCGCGAGGGT GCGCTGAGCC

26281  GGGTGACAAG GCCGAGTGAC AAGGCCGAGT GACAGCCAGG ACGCCTACGC GAAGGCCCTC
```

```
                  -continued
26341  AAGGTGTCCT CGCCGTCGGT CCACCAGACA CCGAGCCGCT GGCGGACCAG GAGCCAGCCG

26401  TCCGGGCCCC GGCGGAATTC CCAGTCGTAG GGGCCGCCCA TGGAGTAGGG GGAGGAGGTG

26461  CTCCCGGGCT CGGTGACGGC GACGAACCAC ATGTAGCCGA TCCCCGTCGC CCGGTCGCCC

26521  GCCACGTCGA CGTGCATGTT GAGGATGTGA TGCTGCATGC TCGCGTAGGG TGATTCCACC

26581  TCCTCCACCT TGGCCCGGAC CGCCTCTTTT CCGTGGATCT TCTCCCACGG CCCGAACTCC

26641  AGCACCGCGT CCTCGGCCCA GCATTCGATC CAGGTCTGCC AGTCCTTGCG GTCCAGCGCC

26701  CGCCATCCGC GGATCATGAG GGCGCGCAGG GCTTCCTTGT CCTCCAGTGC CTGGAGTCTG

26761  CGGGCCAGGC TGTCGTAGTC GGCGGTCGCT GTCATGACGG GCCTCTTTCG TCCATGGGTG

26821  CTGGTCGGTC CTGCCCGATC GAGTCTGGAC CGGTCGAGCA CCGCCGACCA GGCCGAACGC

26881  CGCCTAGGAG CACCGCACCC AGGCGGCACA CCGGCGGGCT CATGGAGGGC AGTTGGGCCA

26941  CCGCCAGGGG TGACCGACCC CGGGCGGTCA GGTCTCCAGC AGGTCAGGTC TCCAGCAGGT

27001  CGGGGGGAAG ATCTCCTCGA TCGTCCACCG GTGTGCGGTC AGGCCCTGCT CGTGGTGGTA

27061  GCGCAGCAGT GTGTCGAGGG CCGCGCGGTT GGCGGCCACG CCATAGGGCC ACCAGTCCTC

27121  GGTCATCAGC TCGGCGTTCT CCTCGTACAG CGCGTTCAGC CAGGGCACCA TGAACGGGGC

27181  CTCCTACAGT CGCCGTCCCT GCCGGTACCG CCGGGCTCCT GCCTCCTTCG CCGCCACAAA

27241  GCCCTCGTAG ACGGCGCGGG CCGGCCAGGG ACACCGGCCC TGTACAGCGC CGGTTCCCGT

27301  GCCGGTGCGA GCGGGTCGCC CCACACCGGG ACCGTGCCCC CGAACCACCG TAAGTCCGCA

27361  GGACGGGGCG CGCGGCCAC CGCACACCAT CGGGGCGGCC GGAGCGGCCG AAGCCCCCTC

27421  ATTCCCCCTG ACGGCCACTG CCGCCACCGT GGTCAGGGGG AATGAGGGGG ATGTTTAGGG

27481  GACGGCCCGC TCGCCGCCGG AACAAGAATC ACAACAACAG CAGCGAGCTT CCTCAAGCTC

27541  GTTGGAGCTT TCTCTCCCGG GCCTTCTTTC CCTTGGGCCG CGCAACCGGA GCGCGGCTGT

27601  CCCGCGCAAG GGGCGATCCC GCGCGGGCCG GTCGCTCCTC CCGCGCGCCC TGCTTCGAAC

27661  CGAGAGGTGT GGCGGCATGC TACGGACTGA CCTGATCCGG CCGGTGCCCG AACTGCTCCG

27721  GGCCAACGCG GATCGCTTCG GTGACAAGCC GGCCTGTTCC GACGGACACC GCACGGTCAG

27781  CCATGCCGAA CTCGAACGCC GTACCCGGCG GCTGGCCGGT CATCTCGCCG GACTGCGGCT

27841  GCACCCCGGC GACCGCGCCA TGATCTGCCT GGGCAACCGC GTCGAGACGG TGGAGAGCTA

27901  CTTCGGCGTT CTGCGGGCGA ACGGCGTGGC GGTGCCGGTC AACCCGCGTT CGACCGATGC

27961  GGAACTCTCC TATCTGCTCG CCGACAGCGG CGCCCGGCTG GTGCTCACCG ATGTCGCCCA

28021  CGCCGAGCAG TTCGACCGGC TGCGGGAACA GTTCCCGGAG CTGAGGGTGG TGGTCAGCGG

28081  GGACGGGCCG CTCCCGAAGG GCTTCATCGC GTTCGAGCCG CTGCCGGACA CGGAGCCGGA

28141  CCTGGCGGCC CGCGACGACC TGGGCCTGGA CGAAGTCGCC TGGATGCTCT ACACCTCGGG

28201  CACCACGGGC CTGCCGAAAG GCGTGCTGTC CACCCAGCGG AACTGCCTGT GGTCCCTGGC

28261  CGCCTGCTAC GTACCGGTGA CGGGGCTGAC CGCCGAGGAC CGTGTGCTGT GGCCGCTGCC

28321  GCTGTTCCAC AGCCTCTCGC ACATCGTGTG TCTGCTGGCG GCCACCGCCG TCGGGGCCGG

28381  CACCCGGATC GTGGACGGGG TGTCGACCTC CGATGTGCTG GACGCGCTGC GCGAGGAGCG

28441  GTCGACCTTC ATCGCCGGAG TGCCGACGCT CTACCACCAT CTGATCGAGG CTGCCCGCGA

28501  GCGCGACTTC GCCACGCCCG AGCTGCGGAT CGCGCTCGTG GGCGGGCGG TGGCCACGGC

28561  CGACCTGGTC AGGTCGTTCG AGGCCACCTT CGGAGTGCCA CTCGTCGACG CCTACGGATC

28621  CACCGAGACC TGTGGCGCGA TCGCGGTGAA CTGGCCCACC GGCCCACGGG TCGAGGGCTC

28681  GTGCGGGCTG CCGGTGCCGG GGCTGACGGT GCGGCTGGTG GACCCCGACA CCGGTGTCGA
```

-continued

```
28741  CGTTCCGGCC GGGCGGGAAG GCGAGTTCTG GGTGTCCGGG CCGAACATCA TGGCCGGGTA
28801  CCACAACCAG CCGGAGGCGA CGGCCGCGGC GCTGCGCGAC GGCTGGTACC GCACCGGGGA
28861  CCTCGGCCGC CGTGACGAGG CCGGATTCTG CACGGTGACC GGCCGGATCA AGGAACTCGT
28921  CATCCGGGCC GGGGAGAACA TCCACCCCGG TGAGGTCGAG GCCGTGCTGC GCACCGTGCC
28981  GGGTGTGGCG GACGCGGCCG TGGTGGGCAA GCCGCACGCG GTGCTCGGCG AGGTCCCGGT
29041  GGCCTTCGTG GTGCCCGGCC CGGACGGCTT CGACCCGTCG GCGCTGCTGG CCACGTGTCG
29101  TGAGCGGCTG TCGTACTTCA AGGTCCCGGA GGAGATCTAC GAGATCGCGC GGGTGCCGCG
29161  CACCGCCTCG GGGAAGATCA CCCCGGCACGT ACTGCTGGAG CTGCCCGCAC GCCTGCGGGC
29221  CGCCGGGGAC GGCCAGTACG ACTCGCTGCT GCGGCTGGAC TGGGTGCCGC ATCCCGCGCT
29281  GCCGGACGCC CCGGCCGGGA CCGGAACCTG GGCGCTGGTG GACGCGGACG CGCTCGGGGC
29341  CGGGCTCGCG GAGGGGCTGC GGGCGGCGGG GGTGGACGTG GCCGATCCGG TGGCCGATTA
29401  CGTGGCCGAT CCGGTGGCCG ATGTCGCTGG AGATGACGGT GCGGCTCCGG ACGTGGTCGT
29461  GGTTGCGCCT CAGGTGGTGG GCCTCCCCGA AGAAGCGGGG GTCCCCGACG AGGCCGGGGT
29521  CACGGCTGGC GAGGCGGCCG ACCGGCTGGC GGCCCGGCTG GCACCTGGC TGGCCGACGA
29581  CCGGCTGGCC GGGACGACGT TCGTGGTGGC CACCACTGGC GCGGTGGCCA CCGGCTCCGA
29641  GGAGAACGCA CCGGAGCCGC TGTCGGCCGC GCTGTGGGGT GTGGTGCGCT CGCTCCAGGC
29701  CGCCTACCCC GGCCGACTGA CGCTGGTGGA CGTGGACGAC GAAGGGGGCG GGGCCGGGGA
29761  GGACGGTCGG GTGGCCGCGC TGTTGCGGGC CGTACAGGAC GGGCACCACC AGGCCGCGAT
29821  CCGTGGCGGA GTGCTGCTGG TCCCGCGCCT GACGCGGATC TCGGTCCCGG CGGAGCCGGG
29881  GCCCGCCCCG GCCCTGGACC CGGACGGACT GGTCGTGATC ACCGGTGGCG ACACCGCCCG
29941  CGGCACCGCG CTGGCCCGCC ATCTGGTGAC CGCGTACGGC GCCCGTAACC TGCTGCTGCT
30001  CAGCGCGAAT GGCCTGCCGG AAGAGGCGGC GGCCGCGTTG CGGACCGAGT TGGCGCGGGA
30061  CGGGGCCCAG GTCTCGATGG CCGTGTGCGA CCCGGCCGAG CGGGCGGCGC TGGACTCGGT
30121  GCTGGACGCA CAGGACCGGC CGGTGACCGC TGCCGTACAC ATCGAGGAGC CGGGTCCGGA
30181  ACGGTCGCTC GCCACCTCGC TGCGCGGCAT GACGCACCTG GAGGAACGGA CGCGGACGGC
30241  CGGGCCCGCG CTGTTCGTCG TCGTCACCTC CGCCGCGGGG GTGCTGGGCT CGCCGGGTCG
30301  CCCCGGACCTG GCGGCCGTCG ACCAGTTCGG CGAAGCCCTG GTGCGGCGGC GCCGGGCGCT
30361  CGGCCTGAGC GGGCTGGCGC TGGCTTGGGG GCCGCTGCCG GGCGAGCAGG GCACGGCACC
30421  GGTGGCCGGT GCCGTTCCCC TGCCCGAGGC GCTGGCCCTG TTCGACGCGG CGCTGACGGC
30481  TGGTCAGGGC CCACTGGTGC TGCTCAGGCC GAGTACGACG GGGCTGGCGG GTGGCGAGCC
30541  GGTGCCCGCG GTGCTGCGTC ACCTGGTGGA CGCGCCGTCC GGCGTACCGG CGTCGGACGA
30601  ACCCGCCGCC GCGGAGTTCC GGCGGCGGCT GGCCGCCGAG AGCGAGTCCG GCCGCCGGCA
30661  CATGGCACTG GCGCTGGTGC GCGAGCACGC CGCGGCGGCG CTGGGGCTGG CCTCGGCCGA
30721  CCCGGTCGAG GCCGACCAGG CGTTCAGCGC GTTCGGCTTC ACCTCACTGA CCGCGGTCGC
30781  GCTGAGGAAC CGGCTGAACG CGGCCACCGG GGCACGGCTC GCCGCCACGG TGGTCTTCGA
30841  CCATCCGACC CCCGCCGGGC TGGCACGCCA TCTGGTGCGG GAGATCACCG GGAAGCGAAG
30901  CGTGCGGGCG CCGGTGCGGG CGCGCGGGGT GTCCGACGAG CCGGTGGCGA TCGTGGCGAT
30961  GGGCTGCCAC CTGCCCGGCG AGGTCGCGAC GCCCGAGGAC CTGTGGCGGC TGGTGGCCGA
31021  CGGGCGGGAC GCGATCGCCG GGTTCCCGGA GGACCGGGGC TGGGACCTGG CCGGGCTCTT
31081  CGACTCCGAC CCGGATGCCG TGGGCAAGTC CTACGTCCGC GAGGGCGGTT TCCTCACCGG
```

-continued

```
31141  CGCGGGCGGA TTCGACGCCG CCTTCTTCGG CATCTCGCCC CGCGAGGCGC TGGCCATGGA
31201  CCCGCAGCAG CGGCTGCTGC TGGAGACCGC GTGGGAGACC TTCGAGAACG CCGGAATCGA
31261  CCCGGGTTCG CTGCACGGCA CCGACGTCGG TGTGTTCAGC GGAGTGATGT ACCACGATTA
31321  CGGGGCCGAC GCCGGGACGG CGGCGGAGGG CCTGGAGGGG CATCTCGGCG TGGGCAGCGC
31381  GGGGAGCGTC GTCTCCGGAC GCGTGGCCTA CGCGATGGGC CTGACCGGGC CGCGGTGAC
31441  GGTGGACACC GCCTGCTCGT CCTCCCTGGT GGCGCTGCAC CTGGCGGTTC AGGCGGTGCC
31501  TACGGGCGAA TGCTCGCTGG CGCTCGCCGG GGGTGTCGCG GTGATGAGCA GGCCGACGTC
31561  GTTCATCGAG TTCTCCCGCC AGCGCGGCCT CGCCCCCGAT GGCCGCTGCA AGTCGTTCGC
31621  GGAGGGCGCC GACGGCACCA ACTGGTCCGA GGGTGTCGGG TTGGTGTTGC TGGAGCGGCT
31681  GTCCGATGCC CGCCGCAATG GGCATCAGGT GCTCGCCGTG GTCCGTGGCA CGGCGGTGAA
31741  CCAGGACGGG GCGAGCAACG GCCTGACCGC GCCCAACGGC CCTTCCCAGG AACGGGTGAT
31801  CCGGCAGGCG CTGGCGAACG CCGGGCTGAC GGTGGCCGAT GTGGACGCGG TCGAGGCGCA
31861  CGGCACCGGC ACGAGTCTCG GCGACCCCAT CGAGGCCCAG GCGCTCCTGG CCACCTACGG
31921  GCAGGAGCGG CCGGAGGGTC AGCCGCTGTG GCTGGGGTCG TTGAAGTCGA ACATCGGGCA
31981  TGCGCAGGCG GCGGCGGGCG TGGCCGGTGT CATCAAGATG GTGCTGGCCA TGCGGCACAA
32041  CACGCTGCCG AAAACGCTGC ACGCGGAGCG GCCCACTACG CAGGTGGACT GGTCGCAGGG
32101  TGCGGTGTCG CTGCTGTCCG AGGCCCGGCC CTGGCCGGAG ACCGGACACC CCCGCCGCGC
32161  CGGAATCTCC TCCTTCGGCG TCAGCGGGAC GAATGCCCAT GTGGTCCTGG AGCAGGCGCC
32221  GCCTGAGGTG GCCGTGCCCG AAGCAGAGGC CAGCGAGGCG GGCACTCCTG GGCTGGTGGC
32281  CACGGGCGGC GTGGTGCCGT GGATGCTGTC GGGTAAGACT CCTGCGGCGC TGCGCGCCCA
32341  GGCCGAGCGT CTGGTCAGCC ACCTGGAATC CGGGGACGCT CCGCGTGCGG TGGACGTGGG
32401  CTGGTCACTG GCCACCACGC GCGCCGCCCT CGATCATCGC GCGGTCATCC TCGCCACGGA
32461  TACCGAGGAC GGCATCGCCA CCGCCCGCGC TTTGGCGGAG GGACGGCCCG ACCCGCTCCT
32521  GGTCACCGGG CAGACCGGGA CAGACGGCAA GACCGTGTTC GTCTTCCCCG GCCAGGGAGC
32581  CCAGTGGGTG GGCATGGGGG CACAACTCCT CAACACCTCG CCCGTCTTCG CCACCCGGCT
32641  ACACGAGTGC GCCGACGCGC TGGCCCCGTA TACCGACTGG TCGCTCATCG ACGTCATCAC
32701  CGGCGCACCC GATGCCCCTT CGCTCGACCG TGTCGACGTC GTACAGCCCG CCACCTTCGC
32761  CGTCGTCGTC TCCCTCGCCA CCCTCTGGCA ATCCATGGGT ATCCACCCCG ACGCCGTCAC
32821  CGGCCACTCC CAAGGCGAAA TCGCCGCAGC CTGCGTCGCC GGACACCTCA CCCTCACCAA
32881  CGCCGCCAAA ATCGTCGCCC TGCGCAGCCA GATCATCGCC GACCACCTCG CCGGACACGG
32941  CGGCATGATG TCCCTCGCCA CCCCGCCGA CACCATCGAC CTCACCAACT GGCACGGCAA
33001  ACTCTGGATC GCCGCACACA ACGGCCCCAA CGCCACCGTC ATCGCAGGCG ACGCCGAAGC
33061  CCTGCACCAA CTCCACGCCC ACTACACCGA CCAAGGCACC CGAGCCCGCA TCATCCCCGT
33121  CGACTACGCC TCCCACACCG GACACGTCGA CACCATCAAG AACGAACTCC ACCAAACCCT
33181  GGCCGACACC ACCACCGAGC CCGGCACCCT CCCCTGGCTC TCCACCGTCG ACGGGGAGTG
33241  GATCGAACCC GACACGCTCG ACAGCGGCTA CTGGTACCGG AACCTGCGCC AAACGGTGCA
33301  GTTCCACACC GCCATCACCA CCCTCGCCGA CCAGGGCTAC CGCACCTACA TCGAAATCAG
33361  CCCCCACCCC GTCCTCACCA CCGCCATCCA AGAAACCCTC GAAACACACA ACACCCCCAA
33421  CGCCGATCGTC ACCGGAACCC TCCGCCGCGA CGACGACACC CCCACCCGCC TCCTCACCAA
33481  CCTCGCCCAC CTCACCACCC ACGGAACACC CGTCAACTGG CCCACCCTCT TCACCGGCAC
```

```
                            -continued
33541   ACACCCCACC CGCATCACCC TCCCCACCTA CCCCTTCCAA CACCACCACT ACTGGCTCCC

33601   CCGCAACACC ACCACAGGCG ATGTGAGTGC CGTGGGCCTC CAGGGCACGG GCCACCCGCT

33661   GGCCGGGGCC GTGGTGAGCG TGCCCGACAC CGGTGGTGTG CTGCTCACCG GCAACTGTC

33721   GGTGGCCACC CACCCCTGGC TGGCCGACCA CGCCGTCTCC GGAACCGTCC TGCTGCCCCG

33781   CGCCGCGATG GCCGAACTCG CCATCCGCGC CGGAGACGAG ACCGCCACCC CCACCCTGCA

33841   AGAACTGGTC ATCGGCCAGC CGATGACACT GCCCGAAGAC GGTGCGCTGC ACGTCCAGGC

33901   ACTGGTCGGC GGCGAGGAGG ACGGGCGCCG AGGGGTACGG ATCTACTCCC GCCCCGACGC

33961   GGCCCAGGAA CAGGAATGGC TGGAGCACGC CTCGGGCACG CTCGCCACGC AGCCGGACCG

34021   TTCGGCCGAG GGTGGCAGGG AAGACGGCAT GGCCGAGTGG CCGCCGCCCG GTGTCGAACC

34081   GATCGCTCTG GATCACTTCT ACGACGACCT CGCCCAGGCC GGGTACGAGT ACGGCCCCGC

34141   GTTCCGCGGG CTGAAGGCGG TCTGGAAGCG CGATGGCGAA GTGGGCGAGG TGTTCGCGGA

34201   GGCCGCGCTG CCGGAGGAGC AGACGGAGGC CGCCGGCCGG TTCGGCATCC ACCCGGCACT

34261   GCTGGACGCC GCGTTGCACG CGAGCAACTT CTGTGTGCCC CCGGTCCCGG GCCAGACGCT

34321   GCTCCCCTTC GTGTGGAACG ACGTACGGCT GCTGGCGGCG GGAGCCACGG CCGTCCGTGT

34381   GCGCGCCCGT GCCACCGGCC CGGATTCGTT CACGATCAGC CTGTACGACA GTACCGGCTC

34441   CCCCGTCGCC TCGGTGGACT CCCTGGTGCT CCGGGCGATC AGTCCCGAGC AGCTCGCCGC

34501   CGCGTCCGGC GGCGCCGATC GGTCCGCTGA TGCGCTGTTC ACGGTGGACT GGACCGAGCA

34561   CCCCACCGCC CTGGGGACCG AGGTCTCCTG GACCACCCTC GGCGACACCC ACACCCACGC

34621   CGACGTGGAC GCAGCCATGG ACGCGCTCAT CGCGGGAGAG GACCGCCCCG GGGCCGTGGT

34681   CGCCGACACC ACGGCCTGGG CCGCCGGGGA CACCGAGCTG CCCACGCGGG CCAGGGACCT

34741   GGCCGCCCGC GCGCTGGACC TGGTGCAGCG ATGGCTAGCC CAACCCGAAC TCGACGACGT

34801   CCGGCTGGTG TTGCTCACCC GTGGGGCGGT GTCCGTACAC GACACCGCCG AGGTCACCGA

34861   TCCGGCCGCC GCCGCGATCT GGGGCCTGGT CCGCTCCGCC CAGTCCGAAC ACCCGGGCCG

34921   GATCGCCCTG GTGGACACCG ACGACGCGTC GCGGGAGGCG CTGCCCGAGG CGGTGGCGTC

34981   CGGCGAACCG CAGGTGGCGC TGCGCCGTGG GCTGCTGTGG GTGCCGCGTC TGGTGCGGTC

35041   GTCGCAGGGT CTCGCCGTAC CGCCCACGA GCACTGGTAC CTCGACGTCT CGGAGAAGGG

35101   CAGCCTGGAG AACCTGGTGC TGCGGCCGGA TCCGGAGGCC ACCGCGCCCC TGGCCACCGG

35161   TCAGGTCCGG ATCGAGGTCC GCGCCGCCGG TCAGAACTTC CGGGACGTGC TCGTCGCGCT

35221   CGGCGGCGTG GCGGGTCAGG AGGGTCTGGG CGGCGAGGGC GCCGGTGTGG TGACCGAGGT

35281   CGGGCCGGGG GTCGAGGGCC TGGCCGTGGG CGACCGGGTG ATGGGTCTGT TCCCGCGCTC

35341   GTTCGGCCCG CTGGCCACCG CGGACGCGCG AACGGTCGCG CCGATCCCCG AGGGGTGGTC

35401   GTACGCCACG GCCGCCGGAG TGCCGGTGGC CTATCTGACG GCGCTGTACG GACTGCGGGA

35461   CCTGGGCAAT GTGCAGCCGG GTGAGACGGT GCTGGTGCAC GCCGCCGCGG GCGGTGTGGG

35521   CATGGCCGCC GTCCAGTTGG CGCGGCACTT CGGCGCCCTC GTGTATGCCA CCGCCCATCC

35581   GTCGAAGCAC CATGTGCTGA CCGCGTTGGG GGTGCGGAG GGGCATCTGG CGTCCAGCCG

35641   CGACCTCGGC TTCGCCTCGG CGTTTCCCGC GCTGGACGTG GTGCTGAACT CCCTCACCGG

35701   CGAGTATGTG GACGCCTCAC TGGGGCTGCT CGGCACCGGT GGCCGCTTCG TGGAGATGGG

35761   CAAGAACGAC ATCCGCGATC CCGCCGTGGT CGCCGCGGCA CATCCCGGTG TGGGCTATCA

35821   GGCCGTTCGAC CTGGGAGGTG ACGCGGGGCC GGACCGGATC CGGGAGTTGC TCACTGAGCT

35881   GGTGGAGCTG TTCGAGGCGG GCCGGATAGA GCCGCTTCCG GTGCGGCAGT GGGACATCAC
```

-continued

```
35941  CCGCGCCCCC GAGGCGTTCC GCTGGATGAG CCAGGGGCGG CACACCGGCA AGATCGTGCT
36001  CACCCTCCCC CGCGCCCTGG ACCCGGACGG CACCGTCCTG ATCACCGGCG GCACCGGAAC
36061  CCTCGGCGCC ACCGTCGCCC GCCACCTCGT CACCCAGCAC GGCACACGCC GACTACTGCT
36121  GGTCAGCCGC CGGGGACCGG ACGCACCCGG CGCCACCGAC CTCACCACCG AACTCACCGA
36181  ACTCGGCGCC ACCGTCCACA TCACCGCATG CGACACCGCC GACCGCGACC AACTCGCCAC
36241  CACCCTCGCC GACATCCCGG CCGACCACCC CCTCACCGCC GTCATCCACA CGGCCGGGAC
36301  GCTCGACGAC GGCACCCTCA CCGCACTCAC CCCGGACCGC CTCGACACCG TCTTCCGCCC
36361  CAAGGTCGAC GCCATCACCC ACCTCCACCA CCTCACCCAC GACCACGACC TGGCCGCCTT
36421  CGTCATCTAC TCCTCCGCCG CCGGAACGCT CGGCAACGCG GGCCAGGCCA ACTACGCCGC
36481  CGCCAACGCC TTCCTCGACG CCTTCGCCCA GTGGCGGCAC GCCCGCCATC GGCCCGCCAC
36541  CTCGCTGGCG TGGGGGCTGT GGAGCGACAC CAGCACGCTC ACCGCGACGA TGGACGCCAC
36601  CGACGTCGCC GCACACGGC GGGCGGGGT GCTGGGCATG ACAACGCCG AGGCGCTGCG
36661  GGTGTTCGAC ACCGGGTTGC GGTCCGGGCG GCCCGCGCTG GTGGCAGCGA AGATCGACCT
36721  CACCGCCCTG CGCGCGCCGG ACGCCGAGTT GTCGCCGCTG CTGCGCGGTC TTGCCCGCCC
36781  GGCGCGCCGC ACCGCGCGGA CCGCGGCCCC GGCGGCCGGT GGTCTGTCGG GGCAGTTGGC
36841  CGGGCTGTCC CCCGCCGGGC AGCGGGAGTT CCTGCTCAAC CTGGTGCGGG CGGAGGCCGC
36901  GGTGGTCCTC GGCCATACCG GGCCTGAGGC GATCGAGCCG ACGGTGGCGT TCAAGGAGAT
36961  GGGCTTCGAC TCGCTGACGG CGGTCGAACT GCGCAACCGG CTGAATGCGG CGACCGGGCT
37021  GCGGCTCCCC GCCACGTTGC TCTTCGACCA CCCGACCCCG GCTCTTCTCA CCGAGCTGTT
37081  CCACACCGAG CTGGGCGGCG GCCCGGCACC CGCCGCGCG GCCCCGGTGA CCGTGCGCGC
37141  CGCCGCTGAC GAGCCGATCG CCGTGGTGGC GATGAGCTGC CGTCTGCCGG GCGGAGTGAC
37201  CGACCCGGAC GGGCTGTGGA ACCTGCTGCT CGGAGAGCGC GACGGCATCA CCGACTTCCC
37261  CCGTGACCGG GGCTGGGACC TGGAGGCGCT GTTCGACGCC GACCCGGACC GGAGTGGCAC
37321  CTCCTATGTG CTGCGTGGCG GGTTCCTCGA GGACGCGGCC GGTTTCGACG CGGACTTCTT
37381  CGGCATCTCG CCGCGTGAGG CGCTGGCGAT GGACCCGCAG CAACGGCTGT CCTGGAAGC
37441  CTGCTGGGAG GTGTTCGAGC GGGCGGGCAT GGACCCGACC GCGGTGGGAG GCGGCGACAT
37501  CGGCGTGTTC GCCGGCGTCA TCAACCAGGA CTACGGCGTG CGGAGCGGTC CCGCTCCCGA
37561  GGACCTCGAG GGCTATATGC TCACCGGCTC GGCGACGAGT GTCGCCTCCG GCCGGGTGGC
37621  CTATGTGCTG GGCCTGGAGG CCCGGCGGT CACGGTGGAC ACGGCGTGCT CCTCCTCACT
37681  GGTGGCCATG CACTGGGCCG TACAGGCATT GCGGCAGGGC GAGTGCTCGA TGGCGCTGGC
37741  CGGGGGCGCC ACGGTGATGG GCGGCCGTC GGCGTTCGTG GAGTTCTCAC GCCAGCGCGG
37801  CCTGGCGCCG GACGGCCTGT GCAAGGCGTT CGGGGCGGGT GCGGACGGCA CCACCTTCAG
37861  CGAGGGTGTC GGGGTACTGC TGCTGGAACG GCTCTCGGAC GCCCGCCGCA ACGGCCACGA
37921  GGTGCTGGCC GTGGTCCGCG GTACGGCGGT GAACCAGGAC GGCGCCAGCA ACGGCCTCAC
37981  CGCCCCCAAC GGCCCCTCCC AGCAGCGCGT GATCCGACAG GCACTGGCGA ACGCCGGACT
38041  GTCGGCCACC GACATCGACG CCGTCGAAGC ACACGGCACC GGCACCGCCC TCGGCGACCC
38101  CATAGAAGCC CAGGCACTCC TGGCCACCTA TGGCCAGGAC CGTCCTGGGG ACGAGCCCGT
38161  ATGGCTCGGC TCGCTGAAGT CGAACACCGG GCACACGCTG GCCGCGGCAG GCGTGTCCAG
38221  CGTCATCAAG ATGGTGCTGG CGATGCGGAA CGGCACGCTT CCGCGCTCCC TGTACGCCGA
38281  CGAGCCCACA CCGGAAGTGG ATTGGTCCCA GGGCGCGGTG TCCCTGCTCA CCGAGGCCCG
```

```
-continued
38341  GCCCTGGCCG GAGACCGGAC ACCCCCGCCG CGCCGGAATC TCCTCCTTCG GCATCAGCGG

38401  CACCAACGCC CACCTCATCC TGGAGCAGGC CCCTCAGCCC GAACCCCAGG CCGAGACCGA

38461  CCCCGAGCCC GAAGCCGCGC CGAAGGCGGA CGACGGCATG GCCACTCCCG GGCTCGTGGC

38521  GACCGGCGGG AGCGTGCCCT GGGTGCTGTC CGCCAAGACC GCCACGGCCC TGCGGGCTCA

38581  GGCTCAACGG CTCCTGGACC ACCTGGAGTC CGGGGTGACC GACCGCCCCC TCGACATCGG

38641  CTGGTCCCTG GCCACCACCC GCACCCTCCA CGACCACCGC GCGGTCATCC TCACCGACAC

38701  CGAGGGCGCT GACGCCACGG CCGCCCTCAC CGCCCTCGCG ACCGAACAAC CCCACCCCCG

38761  CCTCACCACC GGCCACGCCA CCACCCACGG CAAGACCGTG TTCGTGTTCC CCGGCCAGGG

38821  CGCCCAATGG GCAGGCATGG GAGCCCAACT CCTCGACACC TCACCCGTCT TCGCCACCCG

38881  CCTCCACGAA TGCGCCAAAG CTCTCGCCCC CTACACCGAC TGGTCACTCA TCGACGTCAT

38941  CACCGGCGCG CCTGATGCCC CTTCGCTCGA CCGCGTCGAC GTCCTCCAGC CCACCACCTT

39001  CGCCATCATG GTCTCCCTCG CCGCACTCTG GCAGGCCAAC GGCATCCACC CCGACGCCGT

39061  CATCGGCCAC TCCCAAGGCG AAATCGCCGC AGCCTGCGTC GCCGGACACC TCACCCTCAC

39121  CAACGCCGCC AAAATCGTCA CCCTCCGCAG CCAGACCATC GCCCACCACC TCACCGGACA

39181  CGGCGCCATG ATGTCCGTCC TCGCATCCCC CACCTGGGTC CAGGAAACAC TCGCACCCTG

39241  GCACGGACAC CTATGGATCG CCGCCGTCAA CGGCCCCGCA TCCGTCTCCG TATCCGGAGA

39301  CCCCGACGCA CTCGCCGAAT TCGGCACCAC CCTCTCCAAA GCCAAGGTCT ACCGCTGGCA

39361  ACTCCCCGGC GTCGACTTCG CCGGACACTC CGGACACGTC GACACCATCA AAGACCAGTT

39421  GCACAACGTA CTCGACGGCA TCACCGCCAC ACCCGGCCAC ACCGCCTGGA TGTCCACCGT

39481  CGACGCCGAC TGGGCCAACC CCACACACAT CGACCCCGAC TACTGGTACC GCAACCTCCG

39541  CGACACCGTC CGCTTCGAAG AAGCCACCCG AGCCCTCCTC ACCCAGGGCT ACCGCGTCTT

39601  CATCGAGGTC AGCACCCACC CGGTGCTGAC CACCGCCATC CAGGACACCA CCGAATCCCT

39661  CCCCGATACC CCCACCACCA TCACCGGCAC CCTCCGCCGC GACGACGGCG GCCCCGACCG

39721  CGTCCTCACC AGCCTCGCGG AGCTCTCCGC CGCCGGAATT CCGGTCCACT GGCCCACCGC

39781  GTACGCCGGA ACCACACCCT CCCAAGTTCC GCTGCCCACC TACCCCTTCC AGCACCAGCA

39841  CTACTGGCTG GCCGCCACCG GCCACCACGG GGATGTCGGC TCCGTGGGAC TGCGCGACGC

39901  GGCGCACCCG CTGCTGGGGG CCGTGGTCAG CGTGCCGGAC ACCGGAGGGG TGCTGCTCAC

39961  CGGGCGGCTG GCACCGTCGG CGCAGTCCTG GCTGGCCGAC CATATGCTGT CCGGCGTCGC

40021  CCTGGTGCCG GGTACGGCGA TCGTGGAACT GGCCGTACGG GCCGGGACG AGACCGGCAC

40081  ACCGGTGTTG GAGGAGCTGG TCCTCGGCCA GCCGATGCTT CTCCCCGAGG ACGGCTCGCT

40141  TCAGGTGCAG GTCCTGGTCG GCGCGGCCGA GGACGATGAG CGCCGTACGG TGCGGGTCTA

40201  CTCCCGCGGC GACGAGTCCG AGCCCTGGGT CGAGCACGCC TCCGGCATCC TGTCCGCGCA

40261  GGCGCTCATA CCTGTCGAGG CGGAGCGGCA GTGGCCGCCC GCCGGGCGG AACCCGTTGC

40321  CCTGGAGGGC TTCTACGACC GCTTGGCCGA GGCAGGCTAT GAGTACGGTC CGGTGTTCCG

40381  CGGTCTCACC GCGGCGTGGA CGCGCGACGG TGATGTGTTC GCCGAGGTCA CCCTCGGCGA

40441  GGAGCAGCAT GACCTCGCGC GCCGCTTCGG CATCCATCCG GCGTTGCTGG ACGCGGCGCT

40501  GCACGCGAGC AACTTCTGCC CGGGCAACGA GCCCGGCGGC GGGACGTATC TGCCGTTCTC

40561  CTGGAACGGT GTGCAGTTGC ACGCCGACGG CGCCACCGCC CTACGAGTGC GGGTCACCTC

40621  CACCGGGCCG GACAACCTGT CCCTGTACGC GACCGATCCG CACGGGGTGC CCGTGGTGAC

40681  CGTCGGGTCG CTGGTGCTCA GGGAGACCAC CGCGGAGCAG CTCCGCACCA CATCGGCCTC
```

-continued

```
40741  GTCCACCGCG GATTCCCAGT TCACCGTGGA GTGGACCGAA CATGCCCTGG CCCGGGACGA
40801  GGTGGCGTGG GCGGCGCTGG ACGCCGTGCC CGACCAGGAC ACGTGGCCGC CGGTGGTCGT
40861  CGCCGACACC CGGGCATACA CCGCGGAGGG CGGCGAACTA CCGGAGCGCG CCCGTGCGCT
40921  GACCTGCCGG GCACTGGCCG CGATACGGCG TCTGATCAGC GACGACGCAC TCGCCGACAG
40981  CCGTCTGGTG CTGCTCACCC GGGGTGGCAT GGCGGTGCAT GACGACACCG AGGTCACCGA
41041  CCCGGCCGCC GCCGCGGTGT GGGGCCTGGT GCGCGCCGCG CAGGCCGAGC ACCCGGGCCG
41101  GGTGTGCGTG ATCGACACCG ACGACCGGTC GGCCGAGGCC CTGCCCGCCG CGCTGGCCAC
41161  GGAGGAACCC CAGCTCGCGC TGCGTGGCGG AATCGCGTGG GTGCCCCGCC TGGTGCGAGC
41221  GCGCCCGGGC CTGGCGGTCC CGGCCACCGC GGCGTGGCAT CTGGACGTCA CCGAACACGG
41281  CACACTGGAG AACCTCGCCC TGGTGCCCCA CCCTCGGGCG GAGGCGCCGC TGGAGGCGGG
41341  CCAGGTGCGG ATCGCGGTAC GCGCCGCCGG TCAGAACTTC CGCGATGTGC TCATCGCCCT
41401  CGGCATGTAC GAGGCGGAGA TCGGCACCGA GGGCGCGGGC GTGGTGACCG AGGTCGGCCC
41461  GGGCGTGGCG GATCTGGCCG TGGGCGACCG TGTGATGGGC ATGCTGCCCG GTTCGTTCGG
41521  GCCGCTGGTG GTGGCGGACC GGCGGACGGT GGTGCGGATG CCGCGCGGCT GGTCGTTCAC
41581  GGCGGCGGCC GGGGTGCCGG TCGCCTATCT CACCGCGCTG TACGCGTTGC GGGATCTGGG
41641  CGATGTCCAG CCGGGCGAGA CGGTGCTGGT GCACGCCGCA GCCGGTGGAG TCGGCATGGC
41701  CGCCGTACAC CTCGCCCACC ACTTCGGCGC CACCGTCCTC GCCACCGCCC ACCCGGCCAA
41761  ACACCACAGC CTGGAACAGC TCGGGGTGGC CACGGAACGG CGCGCCTCCA GCCGCGACCT
41821  CGCCTACGCC CACACCTTCC CGACCACCGA TATCGTCCTC AACTCCCTCA CCGGCGAACA
41881  CATCGACGCC TCGCTGCGGT TGCTCAACCC CGGTGGCCGT TTCATCGAGA TGGGACGTAC
41941  CGACATCCGG GACGTGGACG AGGTGGCCGC GACGCACCCG GACCGCACCT ATCGCGCGTT
42001  CGACCTGGGC GCGGACGCGG GGCCGGATCG CATCCAGGAA CTGCTGGTCG AGCTGGTGGA
42061  CCTGTTCGAG CAGGGCCTGA TCCCTCCGTT GCCCACCCGG CCGTGGGAGA TCACCCGCGC
42121  CCCCGACGCG TTCCGCTGGA TGAGCCAGGG CCGCCACACC GGCAAGATCG TGCTCACTCT
42181  CCCGCGCACC CCCGACCCCG ACGGCACCGT ACTGATCACC GGCGGCACCG GCACCCTCGG
42241  CACTGCCATC GCCCGTCACC TCGTCACCCA CCACGGTGTA CGCAACCTGG TCCTCACCGG
42301  CCGCCAGGGG CCGAACGCCC CCGGCGCGGC CGACCTTCAC GACGAACTGA CCGCACTGGG
42361  CGCACAAGTA CGGATCACCG CCTGCGACAG CGCCGACCGC GGCCAACTCG CCGCACTCCT
42421  CGCCGGCATC CCGTCCGACC ACCCCCTCAC CGGCATCGTG CACACCGCCG GCACCCTCGC
42481  CGACGGCACC CTCACCACAC TCGACCCCGA CCGCATCGAC ACCGTCTTCC GCCCCAAGGT
42541  CGACGCGGTC ACCCACCTGC ACGACCTCAC CCGCGACCAG GACCTGGCCC TCTTCGCCGT
42601  GTACTCCTCC GCCGCCGGAA TCCTCGGGAA CGCGGGCCAG GCCAACTACG CCGCCGCCAA
42661  CACCTTCCTC GACGCCTTCG TACAGCAGCG GCGCGCGGCG GGGCTGGCCG GCTGTCGCT
42721  GGCCTGGGGC CTGTGGGCGG AGACCAGCGA GCTGTCGGCC GCGCTGATCA CGGCCAACCG
42781  GGATCGCACC CGACACGGTG TCGTCCGCCC GATGACCACC GAGCACGCCC TGAGCCTCTT
42841  CGACTCCGCC CTCGGCCTGG GGCTGCCCCT GGTGGTACCG GCGAAGCTGG ACCCCGGCGC
42901  ACACGAGTCC GCCGCGGGCG CTGTGTCGCC GCTGCTCACC GGGCTCGTCC GGCCGACCCG
42961  ACGCACCCTG CGGTCCACGT CGGGCCAATC CGGCGAAGGC GGTCTGACGG CCCGGCTGGC
43021  GGCGCTGTCC GAGGCCGATC AGCACCGGCT ACTGCTGGAC CTGGTACGGG ACCATACGGC
43081  GACCGTGCTC GGGCACACCG GGAAGGACGC CGTGGACGCC AGGCGCGCGT TCAGCGACAT
```

```
-continued
43141  CGGGGTCGAC TCGCTCATCG CGGTGGAACT GCGCAACCGG CTCGCCGGCG CGACCGGGCT
43201  GCGGCTGCCC GCGACGGTCG TGTTCGACTA CGCGACACCG GAGGCGATGG CCGGACATCT
43261  GCGGTCCGTG GTGGCCGGAG ACACGGCCGC CCCCGCCTCC CCGTCGACGT CGGCGCCCGC
43321  TTCGGCGGTG GCCCCGGCGG ACGACCCGGT GGCCATCGTG TCGATGAACT GCCGACTGCC
43381  CGGCAAGGTC ACCGGCCCAG GGGAACTGTG GGATCTGGTG TCCCAGGGCC GGGACGCGAT
43441  CGGCCCCTTC CCCACGGACC GCGGCTGGGA CGTGGAGACG CTGTTCGACC TCGACCCGGA
43501  CGCCGTGGGC AAGTCCTACG TACGCGAGGG CGGTTTCCTC ACCGGCGCCG GTGACTTCGA
43561  CGCCGAGTTC TTCGGCATCT CGCCACGCGA GGCGCTGGCG ATGGATCCGC AGCAGCGACT
43621  GCTCGCCGAG ACCTCATGGG AGCTGTTCGA GCAGGCGGGC ATCGACCCGA TGTCCGTGCG
43681  CGGACAGGCC ATCGGGGTGT TCGCCGGGGT CATCGACCAG GGATACATCC CCCACTCCGA
43741  GGCGCCCCCG CCGGAGTTGG AGGGCTACCT GATGACCGGC AGCACCACAA GTGTGGCCTC
43801  CGGCCGAGTG GCCTATCTGC TGGGCCTCGA AGGCCCCGCG GTGACGGTGG ACACGGCGTG
43861  CTCGTCGTCG CTGGTGGCGC TGCATCTGGC CGTACAGGCG CTGCGGGCGG GCGAGTGCTC
43921  GATGGCCATC ACCGGTGGCG TGACGGTGAT CGCCAAGCCC GGCGGTTTCA TCAGCTTCTC
43981  CCGCCAGCGC GGGCTCGCGC CGGACGGCCG TAGCAAGTCC TTCAGCGAGG GCGCCGACGG
44041  CACCACCTTC AGCGAGGGCA TCGGTCTGGT GCTGCTGGAA CGGCTCTCGG ACGCCCGCCG
44101  CAACGGCCAT GAGGTACTGG CCGTGATCCG TGGCACCGCG GTGAACCAGG ACGGGGCGAG
44161  CAACGGCCTC ACCGCTCCGA ACGGGCCCTC CCAGCAGCGA GTGATCCGGC AGGCCCTGTC
44221  CAACGCCGGG CTCACAGTGG CCGACGTGGA CGCGATCGAG GCACACGGCA CCGGACACCGC
44281  CCTCGGCGAC CCCATCGAGG CACAGGCACT GCTCGCCACC TACGGCCAGG ACCGCCCGGG
44341  GGACGAACCC GTGTGGCTCG GCTCGCTGAA GTCCAACATC GGCCACACGC AGGCCGCCGC
44401  GGGCATCGCG GGCCTCATCA AGATGGTGCT GGCGATGCGG CATGGCATGC TTCCGCCCTC
44461  ACTGCACGCC GGCGAGCCCA CCACCAAGGT CGACTGGGCG TCGGGGCGG TGTCCCTGCT
44521  GTCCGAGGCC CGACCCTGGC CGGAGACGGG ACACCCTCGC CGCGCCGGAA TCTCGTCCTT
44581  CGGCATCAGC GGGACGAACG CACACGTGAT CCTGGAGCAG GGGCCGGAGG TGGCTGTGCC
44641  CGAGGCGGAG ACGGGCGCTC CTGGGTTGGT GGCCACAGGC GGTGTGGTGC CGTGGGTGCT
44701  GTCCGCCAAG AGCCCTGCGG GGCTGCGGGC TCAGGCCGAG CGTCTGGTCA GCCACCTGGA
44761  ATCCGGGGAC GCTCCGCGTG CGGTGGACGT GGGCTGGTCA CTGGCCACCA CGCGCGCTGC
44821  CCTCGATCAT CGCGCGGTCA TCCTCGCCAC GGATACCGAG CAGGGCACGG CGACCGTCCG
44881  TGCCCTGGCG GAGGGACGGC CCGACCCGCT CCTGGTCACC GGGCAGACCG GGACGGATGG
44941  CAAGACCGTG TTCGTCTTCC CCGGCCAGGG AGCCCAGTGG GTGGGCATGG GGCACAACT
45001  CCTCAGCACC TCTCCCGCCT TCGCCACCCG GCTACGCGAG TGTGCCGACG CGCTGGCCCC
45061  GTATACCGAC TGGTCGCTCA TCGACGTCAT CACCGGCGCA CCCGATGCCC TTCGCTCGA
45121  CCGTGTCGAC GTCGTACAGC CCGCCACCTT CGCCGTCGTC GTCTCCCTCG CCACCCTCTG
45181  GCAATCCATG GGTATCCACC CCGACGCCGT CACCGGCCAC TCCCAAGGCG AAATCGCCGC
45241  AGCCTGCGTC GCCGGACACC TCACCCTCGA CCCCGCCGCC AAAATCGTCG CCCTGCGCAG
45301  CCAGATCATC GCCGACCACC TCGCCGGACA CGGCGGCATG ATGTCCGTCC TCGCCTCGCG
45361  GGAACAGGTC GAGGAAGCCC TCACCCCGTG GCAGGGCAAG CTCTGGATCG CCGCGCACAA
45421  CAGCCCCCAG GCGACCGTCG TCGCAGGCGA CATCGACGCT CTGCACGAAC TCCACGCCCA
45481  CTACACCGAC CAGGACATCC GAGCCCGCAT CATCCCCGTC GACTACGCCT CCCACACCGG
```

-continued

```
45541 ACACGTCGAC ACCATCAAGA ACGAACTCCA CCAAACCCTG GCCGACACCA CCACCGAGCC
45601 CGGCACCCTC CCCTGGCTCT CCACCGTCGA CGGGGAGTGG ATCGAACCCG ACACGCTCGA
45661 CAGCGGCTAC TGGTACCGGA ACCTGCGCCA AACGGTGCAG TTCCACACCG CCATCACCAC
45721 CCTCGCCGAC CAGGGCTACC GCACCTACAT CGAAATCAGC CCCCACCCCG TCCTCACCAC
45781 CGCCATCCAA GAAACCCTCG AAGCCAACGA CACCTCCAAC ACCACCATCA CCGGAACCCT
45841 CCGCCGCGAC GACGACACCC CCACCCGCCT CCTCACCAAC CTCGCCCACC TCACCACCAA
45901 CGGCCACACC CCCGACTGGA CAGCCCTCTA CTCCGCCACC CACCCCCACC CCACGCCCCT
45961 CCCCACCTAC CCCTTCCAAC ACCACCACTA CTGGCTCACA CCGTCCGAGG TGCCGGAGGC
46021 GGTGGCCGAC GGTGTGTTCT GGGAGACCGT GGAGCGGGGC GACCTCGCCT CCCTGGCCGA
46081 TTCCCTCGGC GTCGAGGAGA AGGCGCTGGA GCCCGTCCTG CCGGGGCTGA CGTCGTGGCG
46141 GCGCCGCAAC CAGGACCAGT CCACCGTGGA CGCCTGCTCG TATCGCATCG CCTGGGATCC
46201 GGTGGCCAGC GGGGAGGCGC CCGTACTGCC AGGAGCGTGG CTGGTGGCCG TGGCCTCACC
46261 GCAGACGAGC GACACCGCGG TGACGGGCGT GATCGCCGCG CTGGCCGCGC ACGGCGCCGA
46321 TCCCGTGGTG GTCGAGGTGG ACACGGTGGA GCGGGCGGAG GTGACCGCCC TCCTGCGGGA
46381 GCGGATGTCG GGTTCCGATG ACGAGTACGC CGGGGTGCTG TCCCTGCTGG CATGGGACGA
46441 GCGGACCTGC GAACCCGGCA CGCTCTCCCG CGGCGTGGCG GCCACCGTGG CGCTGATGCA
46501 GGCCGTGGAG GAGATCGGGC TCACCGCTCC CCTGTGGTGC CTGACGCGTG GCGCGGTCGC
46561 CGTGCGTGAA CCCTCCGAGG TGACCAGCGA GTTCCAGCCG CTGGCCTGGG AATGGGCGT
46621 GGTGCAGGGG CTGGATCAGC CGTCCACCTG GGGTGGGATC GTGGATCTGC CGCGGACGCC
46681 GGATGATACG GCCCTTGCCC GGTTGTGCTC GGTGCTTGCC GGAGTGGACG CGGAGGACCA
46741 GGTCGCGGTG CGCGCGTCGG GGGTGTTCGC CCGGCGGATG CGGCGCGAAC CGGTGACGTC
46801 GGCACCGGCG TGGCAGCCAC GGGACACGGT GCTGATCACC GGCGGCACCG GCGGACTCGG
46861 CTCGTACGTG GCCCGTTGGG CCGCGGGTCA CGGCGCCCGG CGTGTGGTGC TGCTCAGCCG
46921 TCAGGGTGCG CAGGCGGCGG GCGCGGCGGA GCTGGAGGCC GAGCTGACCG CGCTGGGCGC
46981 GGACGTGACC ATCGCGGCGT GTGATGTGAC CGACCGGGAC CAGCTCGCGG CCGTCCTGGC
47041 GGAGATTCCG GATGACGTGC CGTTGTCGGC CGTGGTCCAC GCCGCGGGGC TGGCGCTGCC
47101 GGAGAAGCCG CTGTCGAAGA TGACACTCGC CGAGTTCGCC GATATCGGCC GGGCGAAGAT
47161 CGCCGGTGCG CGGCACCTCG ACGATCTGCT GGGGGAACGG GAGTTGGACG CCTTCGTCCT
47221 GTTCTCGTCC GGAGCGGCGG CCTCGGGCAG CGGCGGCCAG AGCGCCTACG CCGCCGGCAA
47281 CGCCTATCTC GACGGGCTGG CGCAGCGCCG CCGCGCACGG GGGCTGGCGG CCACGTCGGT
47341 GGCGTGGGGC GCCTGGGGTG GCGGCCTTGG CACGATCGAC GAGGCGATGG GCGCGCAGTG
47401 GCGCCGTACG GGTCTGATGA CCATGGACCC GCGGCTGGCG GCGCTGGCGA TGGCGCACAC
47461 CGTGGGCAGC GGCACCGCCC ACGGGGTGGT GGCCGACATC GACTGGGAAC GGTTCGCCCC
47521 CGGCTACACC CTGGCCCGGT TCCGGCCGCT GCTGCGGGGA CTGCCCGATG TCATCGACCT
47581 GCTGACCGAG GACACACACG AGGACGGCGC GGGACAGACG GAGCTGATCG CACGGCTGGC
47641 CGGGCTGAGC CCCGGGGACC AGGAGCGGCT GCTCACCGAG CTGGTGCAGG CCGAGGCCGC
47701 GGCCGTACTC GGACACGCGA GCGCCGATGC CACCGGGGAC CGTCCGTTCA GCGAGATCGG
47761 ATTCGACTCG CTGACGGCGG TGGAGCTGCG CAATCGCCTC AATGCCGGCA CGGGGCTGAA
47821 GCTGCCCGCG ACGATGGTGT TCGACCACCC GCGGCCCAGT GCGCTGGCGC GCCGTATCCG
47881 CACCGAACTC GGCCAGACCG ACACCTCGTC GGTGGACTCG GTGCTGGCCG AGCTGGAGCG
```

-continued

```
47941  GCTGGAAGCA CATTTGGCGG CGCTGCCGAA GGAGAAGATC GAACGCGCCC GGATCACCTC
48001  GCGGCTACAG CGGATGACCA CCAAGGTCGC CGAGATCGAG GCCAACGGCG CGGGCGGCGA
48061  AACCGTCACC GAACGACTCG ACACGGCGAA CGCCGACGAC GTGTTCGCCT TCATCGACCA
48121  GGAGTTCGGC GTGGACTGAT TCCCCGTCTC GTCTCCGCTC ACCGATTTCA CCCACGAGGC
48181  TCTTGGCGAG GTCCAGATGG CGAATGACGA AAAGCTCCTC AACTACCTCA AGCGGGTTAC
48241  CGCCGACCTG CACCAGACGC GGGAACGGTT GCGCAAGGCC GAGGCCGCGA CGGAGGAGCC
48301  GATCGCCATC GTCGGCATGG GCTGCCGCTT CCCGGGCGGC GTGACCACCC CAAACGGGCT
48361  GTGGGATCTG GTGGCCGACG GCCGGGACGC GATCGCCGGG TTTCCGGAGG ACCGCGGCTG
48421  GAACCTGGAG AACCTCTTCC ACGCCGACCC TGACTCCGTC GGCACCTCCT ATGTGCGCGA
48481  GGGCGGTTTC CTCGCCGACG CGGCGGAGTT CGACGCCGAG TTCTTCGGCA TCTCCCCGCG
48541  TGAGGCGCTG GCCACCGACC CGCAGCAGCG GCTGCTGCTG GAGACCGCGT GGGAGACCCT
48601  CGAGCACGCG GGAATCGACC CGAGTTCGCT GGCGGACAGC GACGTCGGCG TGTTCACCGG
48661  CCTGGCCAAC GGTGACTACG CGCTGACCGT GGACCAGGTG CCGGAGGGGT TCGAGGGATA
48721  TCTGGGTCTC GGTGGCGCGG GCAGCATCGC GTCCGCCGC ATCTCGTACT CGCTCGGTCT
48781  GCTCGGCCCG GCGGTCACTC TGGACACCGG GTGCTCCTCG TCCCTCGTGG CGATGCACTT
48841  GGCCAGTTAT GCGCTCCGGT CCGGGGAGTG CTCCATGGCG CTCGCCGGTG GCGTGATGGT
48901  GATGGCCACC CCCGGCGGCT TCGTCGGATT CTCCCGGCAG CGGGGGCTGG CGCGCGACGG
48961  GCGCTGCAAG TCCTTCGGTG AGGGCGCGGA TGGCACCAAC TGGTCCGAGG GCGCCGGTCT
49021  TGTGCTGCTG GAACGACTGT CCGATGCCCG CCGCCATGGG CATGAGGTGC TCGCGGTCAT
49081  CCGTGGCACC GCCGTCAATC AGGACGGCGC TTCCAACGGC ATCACCGCGC CCAACGGCCC
49141  GTCCCAGGAA CGGGTGATCC GCCAGGCACT GGCGAACGCC GGGCTGACGG TGGCCGATGT
49201  GGACGCGGTC GAGGCGCACG GCACCGGCAC GAGTCTCGGC GACCCCATCG AGGCCCAGGC
49261  GCTCCTGGCC ACCTACGGCC AGAACCGCCC GGAGGATCAG CCGCTGTGGC TGGGCTCCAT
49321  CAAGTCCAAC ATCGGCCATA CCCAGGCCGC CGCGGGTGTC GCGGGCGTCA TCAAGATGGT
49381  GCAGGCCATG CGGCATGGCG TACTGCCCAA GACACTCCAC GCCGACGAGC CCACCACCAA
49441  GGTGGACTGG TCGCAGGGTG CGGTGTCGCT GCTGTCCGAG GCCCGGCCCT GGCCGGAGAC
49501  CGGACACCCC CGCCGCGCCG GAATCTCCTC CTTCGGCGTC AGCGGGACGA ATGCCCATGT
49561  GATCCTGGAG CAGGCGCCGC CTGAGGTGGC CGTGCCCGAA GCAGAGGCCA GCGAGACGGG
49621  CACTCCTGGG CTGGTGGCCA CGGGCGGCGT GGTGCCGTGG ATGCTGTCGG GTAAGACTCC
49681  TGCGGCGCTG CGGGCTCAGG CCGAGCGTCT GGTCAGCCAC CTGGAGTCCG GGAGCGACGC
49741  CAACCCGGTC GATGTGGGCT GGTCGCTGGC CACCACCCGG GCGGCTCTGG ATCACCGCGC
49801  GGTCATCCTC GCCACGGATA CCGAGGACGG CATCGCCACC GCCCGCGCTT TGGCGGAGGG
49861  ACGGCCCGAC CCGCTCCTGG TCACCGGGCA GACCGGAACA GACGGCAAGA CCGTGTTCGT
49921  CTTCCCCGGC CAGGGAGCCC AGTGGGTGGG CATGGGGCA CAACTCCTCA ACACCTCCCC
49981  CGCCTTCGCC ACCCGGCTAC GCGAGTGTGC CGACGCGCTG GCCCCGTATA CCGACTGGTC
50041  GCTCATCGAC GTCATCACCG GCGCACCCGA TGCCCCTTCG CTCGACCGTG TCGACGTCGT
50101  ACAGCCCGCC ACCTTCGCCG TCGTCGTCTC CCTCGCCACC CTCTGGCAAT CCATGGGTAT
50161  CCACCCCGAC GCCGTCACCG GCCACTCCCA AGGCGAAATC GCCGCAGCCT GCGTCGCCGG
50221  ACACCTCACC CTCACCAACG CCGCCAAAAT CGTCGCCCTG CGCAGCCAGA TCATCGCCGA
50281  CCACCTCGCC GGACACGGCG GCATGATGTC CGTCCTCGCC TCGCGGGAAC AGGTCGAGGA
```

-continued

```
50341 AGCCCTCACC CCGTGGCAGG GCAAGCTCTG GATCGCCGCG CACAACAGCC CCCAGGCGAC

50401 CGTCGTCGCA GGCGACATCG ACGCTCTGCA CGAACTCCAC GCCCACTACA CCGACCAGGA

50461 CATCCGAGCC CGCATCATCC CCGTCGACTA CGCCTCCCAC ACCGGACACG TCGACACCAT

50521 CAAGAACGAA CTCCACCAAA CCCTGGCCGA CACCACCACC GAGCCCGGCA CCCTCCCCTG

50581 GCTCTCCACC GTCGACGGGG AGTGGATCGA ACCCGACACG CTCGACAGCG GCTACTGGTA

50641 CCGGAACCTG CGCCAAACGG TGCAGTTCCA CACCGCCATC ACCACCCTCG CCGACCAGGG

50701 CTACCGCACC TACATCGAAA TCAGCCCCCA CCCCGTCCTC ACCACCGCCA TCCAAGAAAC

50761 CCTCGAAGCC AACGACACCT CCAACACCAC CATCACCGGA ACCCTCCGCC GCGACGACGA

50821 CACCCCCACC CGCCTCCTCA CCAACCTCGC CCACCTCACC ACCCACGGAA CACCCGTCAA

50881 CTGGCCCACC CTCTTCACCG GCACACACCC CACCCGCATC ACCCTCCCCA CCTACCCCTT

50941 CCAACACCAC CACTACTGGC TCCCCCGCAA CACCAGGACA GGCGACATCG CCTCAGCCGG

51001 TCTCCACGAC CCCGCGCACC CGCTTCTCAC CGCCGCCGTC CACCTCCCCG ACACCGGTGG

51061 CACCGTCCTC ACCGGGCGGC TCTCCCTGAC CACCCACCCC TGGCTGGCCG ACCACACCGT

51121 GTCCGGTGCC GTCCTCCTCC CCGGCGCCGC GATGGCCGAA CTCGCCATCC GGGCCGGAGA

51181 CGAGACCGCC ACCCCCACCC TGGATGAGCT GGTCATCGAG CAGCCACTGG CGCTACCGGA

51241 CAGTGGCTTC CTGGACATCC GGGTGGTCGT GGGCGGCCCT GACGAGGCCG GCGTCGGGA

51301 CGTACGCATC TACTCCCGCG CCGCAGAAGA ATCAGCGCAG TGGACGGTGC ACGCCACCGG

51361 CACGCTGGCC CAGGACACCA CGGCTCCTCC GTCGCCCACC GCCGCCGAAT GGCCACCCGC

51421 CGGTGCCGAG CCGGTGGCCG TCGAGGGCCT GTACGAGCAG ATGGCCGAGG GGGGCTACGA

51481 CTACGGACCG ACGTTCCAGG GCCTGAAGGC GGTATGGACC CGCGACGGCG ACGTGGGCGA

51541 GGTGTTCGCG GAGGCCGCGC TGCCGGAGGA GCAGACGGAG GCCGCCGGCC GGTTCGGCAT

51601 CCACCCGGCA CTGCTGGACG CCGCGTTGCA CGCGAGCAAC TACTGCCTGC CCGGGGAGCC

51661 CGGCGGCCGT ATGCTGCTGC CGTTCGCGTG GAACGACATA CGCCTGCACG CCACCGGTGC

51721 CACTTCGGTG CGCGTACACG CCCGTTACAC CGAGGACGAC GGCCTCTCCG AGGTCCTGGT

51781 CGACACGGCC GGAGGGCTGG TCGCGTCGAT CGGTTCGCTG GTTCTGCGGG AGGTCGACGC

51841 GGCGCAGCTC GAAGCGCTGG CCTCCACCTC GGTGAACGAC GCGCTGTGGA CGGTCACTTG

51901 GACCGAACAC ACCGCCACCA CGGACGAGAT CCGGTGGGGC ACCCTAGGGG ACGTCTCACC

51961 CGTCCTCGCC GCCGCCGAAG CCCCGGCCTT CGCCGATGTC ACACAGATCG CCACCGCGCC

52021 CGCCACGGAG ATCGCCGGGA CCGAGGACCG GCCCGCGCTG ATCGTCGCCG ACACGACAGC

52081 ATGGCAGTCG CGGGACGCCG ACCCCATCAC GCGGGCGCGC GAACTGGCCA CGCGGGCGCT

52141 GGACCTGTTG CAGCGGTGGG TGACGCTGCC TGAGCTGTCG GAAACACGGC TGGCGGTCCT

52201 CACCCGCGGT GCGATGGCCG TACACGACTC GGCCGAGGTC ACCGACTCCG CCGCGGCGGC

52261 GATCTGGGGT CTGGTCCGCT CGGCCCAGTC CGAACACCCC GGCCGCATCC AGCTCATCGA

52321 CGCCGACGGC CACTCGGACC ACACACTGCG CAGCGCACTG TCCACCGCAC TCACCACCGA

52381 CCAGCCCCAA CTGGCCCTCC GCGACAACAC GCTCTGGGCG CCCCGGCTCA CCCCGACAAC

52441 ACCCGCCGAC ACACCCGCCC AGCCGCTCCC TCTCAACCCC GAGGGCACCG TTCTCGTCAC

52501 CGGCGGCACC GGCACCCTCG GCGCTCTCAC CGCCCGCCAT CTCATCACCC ACCACGGCGC

52561 CCGGCACCTG CTCCTGATCA GCCGCCAGGG GCCCGACGCC CCCGGCGCCA CCGACCTCAC

52621 CACCGAACTC ACCGAACTCG GCGCCACCGT CCACATCACC GCATGCGACA CCGCCGACCG

52681 CGACCAACTC GCCACCACCC TCGCCGACAT CCCGGCCGAC CACCCCCTCA CCGCCGTCAT
```

-continued

```
52741  CCACACCGCC GGAACCCTCG ACGACGGCAC CCTCACCGCA CTCACCCCGA ACCGCCTCGA
52801  CACCGTCTTC CGCCCCAAGG TCGACGCCAT CACCCACCTC CACCACCTCA CCCACGACCA
52861  CGACCTGGCC GCCTTCGTCA TCTACTCCTC CGCCACCGGC ACCCTCGGCA CCCCCGGTCA
52921  GGCCAACTAC GCCGCCGCCA ACACCTACGC CGACGCCCTC GTCCACCAAC GCCACGCCGC
52981  CGGGCTCCCC GCCACCTCCC TCGCCTGGGG GCTATGGGAA ACCACCAGCG CCCTCACCGC
53041  CACCATGAAC ACCGAGGACC GCCGACGCAC CCACCGTGGC GGTGTGGCCC CCCTGACCGA
53101  CGACGAGGGG CTCGCCCTCC TCGATAGGGC CCTCACCGCC ACCCACCACC CCCACCTCGT
53161  CCCGATCAAG ATCAGCCCGG CCTCCCTTCG GGCCGATGAC ACGGCGCAGC CCGTTCCGCC
53221  GCTGCTCCGC CACCTCGTAC GGCGCCCCAC GCGCCGTACG GCCCACACAC CGGCCCCCGC
53281  CGACACCCTG TCGCTCGCCC AACGGCTCGC CGCCCTCGAC CAGGGCGAAC GGCTACGGCA
53341  CCTCACGGAG CTCGTCCGCA CCGAGGCGGC GGCCGTACTC GGACATACGA CGATCGACAG
53401  CATCGGGCCG GACCAGCCCT TCCGCGACGT CGGGTTCGAC TCCCTCACGG CGGTGGAACT
53461  GCGCAACCGC CTCAATGCGG CCACGGGACT GCGGCTCCCC GCGACCGTGG TGTTCGACTA
53521  CCCGACCCCG GCGATCACGG CCGGGTATCT GCGGGACGAG CTGTTCGGCC CGGCGGAGGC
53581  GGCCCCGGCC GCCGTCGCCG GGCCGGGGGC CGACGCGGAC GATCCCGTGG TCGTCGTCGG
53641  CATGGCCTGC CGGCTCCCCG ACGGGTGACC CGACCCGGAC GGGCTGTGGC GGCTGGTGGC
53701  CGACGGGGAG GACGGCATCG GGGCGTTCCC CACCGACCGC GGTTGGGATC TGGACACGCT
53761  CTTCGACCCC GACCCGGACC GGGTGGGCGC GACCTACGTC CGCGAGGGCG GGTTCGTGGC
53821  GGGGGCCACC GAGTTCGACG CGGACTTCTT CGGCATCTCC CCGCGTGAGG CCGTGGCGAT
53881  GGACCCGCAG CAACGGCTGC TGCTGGAGAC CGCGTGGGAG ACCTTCGAGC AGGCCGGTAT
53941  CGCCCCACGG TCGGTGCAGG GCAGCGACAC CGGTGTGTTC GCCGGGGTCA TCTACCACGA
54001  CTACGGGACG AACGCCGGTG AGCTGCCCGA GGGCTCGGAG ACCTATCTGA GCACGGGCAA
54061  ATCGGGGAGC GTGGTGTCCG GGCGGGTGGC CTACGCGCTG GGCCTGACCG GTCCCGCGGT
54121  GACGGTCGAC ACGGCGTGCT CCTCCTCGCT GGTGGCCATC CACTGGGCGG CCAAGGCGGT
54181  GCGGGAGGGC GAGTGCTCGA TGGCCCTGGC CGGGGGCGTG ACGGTGATGT CGACCCCGGA
54241  TGGGTTCGTG AGCTTCTCGC ACCAGCGCGG GCTCGCCCCC GACGGCCGCA GCAAGTCCTT
54301  CGGCGAGGGC GCCGACGGCA CCACCTTCAG CGAGGGCGTC GGGCTCGTGC TGCTGGAGCG
54361  GCTCTCCGAG GCGCGGCGCA ACGGTCACGA GGTGCTGGCC GTGGTCCGCG GTACGGCGGT
54421  CAACCAGGAC GGCGCCAGCA ACGGCCTCAC CGCCCCCAAC GGCCCCTCCC AGCAACGGGT
54481  GATCCGCCAG GCCCTGTCCA GTGCCGGACT GTCGGCGACC GACATCGACG CCGTCGAAGC
54541  CCACGGCACC GGCACCGCCC TCGGCGACCC CATAGAAGCA CAAGCGCTGC TGGCCACCTA
54601  CGGCCAGGAC CGCCCCGCCG ACCAGCCCCT CTGGCTGGGC TCACTGAAGT CCAACATCGG
54661  CCACACCCAG GCCGCCGCGG GCATCGCGGG CGTCATCAAG ATGATCCAGG CCATGCGGCA
54721  CGGCATGCTG CCCAGGACAC TCCACGCCGA CGAGCCCACC ACCAAGGTCG ACTGGACGTC
54781  GGGCGCGGTG TCCCTGCTCA CCGAGGCCAG GCCCTGGCCG GAGACCGGAC ACCCCCGCCG
54841  CGCCGGAATC TCCTCCTTCG GCGTCAGCGG CACCAACGCC CATCTCATCC TCGAACAGGC
54901  CCCGGAGGAG GCGGCCACCG CACCAGAGAC CACGGAGCCG GAGGCTCCCG GCTGGTGGC
54961  CACGGGCGGC GCGGTGCCGT GGGTGCTGTC CGCCAAGAGC CCAACGGCCC TGCGGGCGCA
55021  GGCCGAACGC CTGATCGCCC ACCTTCACGC CCACCCCGAG ACCGACCCGG TGGACATGGG
55081  CTGGTCGCTG GCCACCAGCC GCGCCGCCCT GGAACACCGG GCGGTCGTCC TCGCCACCGA
```

-continued

```
55141  TCTCGACCAG GCGAdCGCCG CCCTCACCGC CCTCAGCGAA GGGCAGCCGC ACCCCAGCCT
55201  GATCACCGGG GAGACCGGCA GTGATGGCAA GACCGTGTTC GTGTTCCCCG GCCAGGGCGC
55261  CCAATGGGCA GGCATGGGAG CCCAACTCCT CGACACCTCA CCCGTCTTCG CCACCCGCCT
55321  CCACGAATGC GCCGAAGCTC TCGCCCCCTA CACCGACTGG TCACTCATCG ACGTCATCAC
55381  CGGCGCGCCT GATGCCCCTT CGCTCGACCG CGTCGACGTC CTCCAGCCCA CCACCTTCGC
55441  CATCATGGTC TCCCTCGCCG CACTCTGGCA GGCCAACGGC ATCCACCCCG ACGCCGTCAT
55501  CGGCCACTCC CAAGGCGAAA TCGCCGCAGC CTGCGTCGCC GGACACCTCA CCCTCACCAA
55561  CGCCGCCAAA ATCGTCACCC TCCGCAGCCA GACCATCGCC CACCACCTCA CCGGACACGG
55621  CGCCATGATG TCCGTCCTCG CATCCCCCAC CTGGGTCCAG GAAACACTCG CACCCTGGCA
55681  CGGACACCTA TGGATCGCCG CCGTCAACGG CCCCGCATCC GTCTCCGTAT CCGGAGACCC
55741  CGACGCACTC GCCGAATTCG GCACCACCCT CTCCAAAGCC AAGGTCTACC GCTGGCAACT
55801  CCCCGGCGTC GACTTCGCCG GACACTCCGG ACACGTCGAC ACCATCAAAG ACCAGTTGCA
55861  CAACGTACTC GACGGCATCA CCGCCACACC CGGCCACACC GCCTGGATGT CCACCGTCGA
55921  CGCCGACTGG GCCAACCCCA CACACATCGA CCCCGACTAC TGGTACCGCA ACCTCCGCGA
55981  CACCGTCCGC TTCGAAGAAG CCACCCGAGC CCTCCTCACC CACGGCCACC GCGTCTTCAT
56041  CGAAGTCAGC ACCCACCCCG TCCTGACCAC CGCCATCCAA GAGACCACCG AAACCCTCCC
56101  CGAAGTCCGG GCCACCATCA CCGGGACGCT GCGCCGCGAC GACGGCGCCG CGGACCGCGT
56161  TCTCGCGGGG CTGGGCGGGC TGTTCGCGGC CGGGGTGCCG GTGGACTGGG GCGCTCTGTT
56221  CGCCGGTACC GGGGCCCGCC GGGTGCCGCT GCCCACGTAC GCCTTCCAGC ACCGGCACTA
56281  CTGGCTGGAG CCCGCCAGGA CCCCGACGCG GGCCGAGACC GCCGACGGCT CCCTGTGGGC
56341  GGCCATCGAG GACGGCGACA CGCAGTCCCT CGCACGGGAT CTCGAGGTGG ACGCGGCGGC
56401  CCTCGGCACG GTGCTGCCCG CGCTGGCCTC ATGGCGTCGG CGCAGCCGGG AGGATTCCCT
56461  CACGGACGCA TGGCGGTACC GGATCGGCTG GACCCGGGTG GCCGCGGCCG ATCCACAGAT
56521  GTCGGGCCGG TGGCTGGTGC TGGTCCCGGC CGTGCGGGCG GGCTCGGCGC GGGTCCGAGC
56581  GGTGCTGGAC GGGCTGGCCG CGCGGGGCGC CGAGGTGGTG GCCGCCGAGG TCTCCGAGAC
56641  CGGCCGGGAG GCGCTGGGCG ACCAGGTCAA GTCGGCGGAC GGCGGTGCCG GGGTGGTGTC
56701  CCTGCTCTCG TGGGACGACC GCGCCGACAC CGAGTACGGC ACCGTGTCCA CGGGCACCGC
56761  GGCCACGCTC GCGGCGGCGC AGGCGTTGCG GGACCACGGC ATCACCGCCC GCTGTGGTG
56821  CGTCACCAGT GGCGGGGTCG CGGTGGCCGG TGAGACGGCC GACCCGGTGC AGTCGGCGGT
56881  GTGGGATTC GGCGCCGTGC TCGGGCTCGA CCACCCGGAC ACCTTCGGCG GCCTGATCGA
56941  CCTGCCGGCC GAAAGGGAGG GTGACGGCGA GGCGCTGCCG GACGGGCTGT TCGCGGCGCT
57001  GTCGTCTCCG GAGGGGGAGG ACCAGCTCGC GGTGCGCGCC GACGGGCTGT TCGCACGCCG
57061  GATGGTGCGC GACCGGGACG GCTCCGGCAG CCTCTGGAAG CCACGCGGCA CCGTGCTGGT
57121  CACGGGCGGC ACCGGCGGGC TCGGCTCGCA TGTGGCGCGC TGGCTCGCCA CGAGCGGGGC
57181  GGACCATGTG GTGCTGCTCA GCAGGCAGGG CGGTGACGCG CCGGGCGCGG CCGAACTGGT
57241  GGCGGACCTG GCGGGGGTGC AGGTCACGCT CGCCGCCTGT GATGTGACCG ACCGGGAGGC
57301  CGTGGCCGCG GTGCTGGCGG AGGCGGAGCG GACCCATCCG CTGACCGCGG TGGTGCACAC
57361  CGCCGGTGCC GGGCTGCCCT CGGCTCCGGT CACCGAGGTG ACCGCCGAGG AGTTCGCCGC
57421  CGTGACGGGG GCGAAGGTGC GCGGGGCGCT GGTGCTGGAC CAGCTCGTCG GCGATCGGCA
57481  GCTCGACGCG TTCGTGCTGT TCTCCTCCGG CGCCGGTGTC TGGGGCAGTG GCGGGCAGGC
```

```
                                               -continued
57541  CCCGTACGCG GCGGGCAACG CCTTCCTGGA CGGGCTGGCG GCCCGGCGGC GGGCCCACGG

57601  GCTGGCGGCC ACATCGGTGG CGTGGGGCGG CTGGGGCGGC GGGCTCGGCA TGATCGACGC

57661  CGACGGCGGC GATCAGTGGC GCCGTATCGG CATCCTGCCG ATGGATCCGG CGCCCGCGTT

57721  GCGTGCGATG GCGCGGGCAG TGGGCAGTGG TCTGCCGAAT GCGATTGTCG CGGACGTCGA

57781  CTGGGCGCGG TTCGTGCCGG GATACACGAT GGCCCGGGAG CGGCCGCTGC TGCGGCAGTT

57841  GCCCGAGGTC GCCGAGATCC TGGCGGCGGA CGCGCGGGGC GGGGCGCAT CGCGGCGGGA

57901  GGTGCTTCTG GCAGCCTGG CCGAGCTGAC CGGCCCGGAG CAGGAGGTGT TCCTGACCGA

57961  TCTGGTGCGG CGTGAGGCGG CGGCCGTGCT CGGGCATGCG GACGGGACG CGGTGGAGCC

58021  GGAGCGTGCG TTCAAGGACA CCGGGTTCGA CTCGCTGACC GCGGTGGAGC TGCGCAACCG

58081  GATCAACGCG GCCACCGGGC TCCAGCTCTC CCCCACGGTG GTGTTCGACT ATCCGAAGCC

58141  GACCACGCTG GCGAGGAGGC TGCGTACGGA GCTGGTCCCC GCCGTGAATG GGGACGCGAA

58201  CGGGGGCATG GACGGGACG GGACCGCGGA TGGCGGGGCC GTCGGCGCGG AGGGCCGCGA

58261  GCGGCAGATC CGGCGGGTGC TGGCCTCGGT GCCGTTACGC CGCTTCCACG AGCTGGGGGT

58321  GCTGGACGCG CTGGTGCGCC TCGCGGACTC CGCGGCCGGT GACCCGAGCG GTCTGCGCGA

58381  CCTGGGCGAC CTGGACACCG CCGCGGAGGC GGAGACCTCC GCGCTCGCGG AGCTGGATGC

58441  CGACGAGCTG GTGAGCCGGG CGATGCGCGG CACGACCTTC GGAAACCACT GACGCCGCGG

58501  TTGCGGAGAG GAGTACATAT GGCTGCGTCC CGCGAAGACC TGGTCAAGGC GCTGCGTACC

58561  TCGCTGATGG ACGCCGAGCG GCTGAGGCGG GAGAACGACC GGCTGATCGC CGAGTCCACC

58621  GAACCGGTGG CGATCGTGGC GATGGCGTGC CGGCTGCCGG GCGGGGTGAC CGACCCGGAG

58681  TCGCTGTGGA AGCTGGTGGA CGAGGGCGG GACGCGATCG GGCCGTTCCC CACGGATCGC

58741  GGCTGGGACC TGGAGACGCT GTTCGACGCC GATCCGCACG CCGTGGGCAA GTCCTACGTA

58801  CGCGAGGCGG GATTTCTGGA GGGGCGGGC GGGTTCGACG CCGCGTTCTT CGGCATCTCG

58861  CCGCGCGAGG CCCTGTCGCT GGACCCGCAG CAGCGGCTGC TGCTGGAGAC CGCGTCGGAG

58921  ACCTTCGAGC GGGCGGGGAT GGATCCGCGG TCGGTGGAGG GCCGGGACAT CGCGGTGTTC

58981  GCCGGGGGCA GCGGCCAGGG GTACGGCGGC GGTCCGGGTG ACGCGCCCAA GGGCCTGGAG

59041  GGTTATCTGG GGGTCGGGGC TTCCGGCAGT GTCATCTCCG GCGTGTGTC GTACACGCTC

59101  GGGCTGACCG GGCCCGCCGT CACCGTGGAC ACCGCCTGCT CGTCCTGCT GGTGGCCGCC

59161  CATCTCGCCG TACAGGCCCT GCGGTCCGGC GAATGCTCCA TGGCGCTGGC CGGTGGTGTC

59221  GCCGTGATGG CCAGCCCAC CGCCTTCGTC GAGTTCTCCC GGCAGCGTGG CCTGGCGCCC

59281  GACGGGCGCT GCAAGTCCTT CGGCGAGGGC GCCGACGGCA CCACCTGGTC CGAAGGTGTC

59341  GGGCTCGTGT TGCTGGAGCG GCTGTCCGAC GCCCGCCGCA ACGGCCACGA CGTGCTGGCC

59401  GTGATCCGGG GCACCGCGGT CAACCAGGAC GGCGCCTCCA ATGGCCTCAC CGCGCCCAAC

59461  GGCCCCTCCC AGGAGCGGGT GATCCGGCAG GCCCTGTCCA ACGCCGGGCT GACGGTGGCC

59521  GACGTGGACG CGGTCGAGGC TCACGGCACC GGCACCGCCC TCGGCCACCC CATCGAAGCC

59581  CAGGCCGTTC TCGCCACCTA CGGCCGGAAA CGCCCCGCCG ACCAGCCCCT CTGGCTCGGC

59641  TCCCTCAAGT CCAACATCGG CCACGCACAG GCCGCCGCGG GCATCGCCAG TGTCATCAAG

59701  ACCGTCATGG CCTTACGCCA CGGCCGGCTG CCGAAGACCC TCCACGCCGA ACAGCCCACC

59761  TCCCAGGTGA ACTGGACGTC GGGCGCGGTG TCCCTGCTCA CCGAGGCGCG GGCGTGGCCG

59821  GAGACCGGAC ACGCCCGCCG CGCCGGGATC TCCTCCTTCG GCGTCAGCGG AACGAACGCC

59881  CACGTCATCC TGGAACAGGC CCCCGAGGAA GCCGAGGCGA CCGGGGAGAA CACGGCCGGT
```

-continued

```
59941  CAGGAACCGT CCGTACGCTC GGCGGAGTCC GCCGACCCCG GTCCGGTGGC CACCGGCCAG
60001  GTGGTGCCGT GGGTGCTCTC GGGCCATACG CGGGAGGCGC TGCGTGCCCA GGCCGCCCGG
60061  CTGCTGACCC AGGTACGGGA GACGCCCGCC GACGGCCTCC GGGACGTGGG CTGGTCACTG
60121  GCCACCACCC GGACCCGGCT GGACCACCGC GCGGTCGTGC TGTGCGCCGA TGCCGAGCAG
60181  GCCGTCGCGG GGCTGGAGGC GGTGGCCTCG GGCGCGTCCG CCCGGTCGGC GGTCAGCGGG
60241  TCCGTGGCCG CCGGAAAGGT GGCGGTGCTG TTCACCGGGC AGGGCAGCCA GCGAGCCGGA
60301  ATGGGCCGTG AACTGCACGG CGGCTACCCG GTGTTCGCGC GGGCCTTCGA CGCCGTGTGC
60361  GCCCAGTTCG GCGACCTGCC CGACGGGGAC GACAAGGTCT CGCTCGCCGA AGTGGTCTTC
60421  GCCGAGGAGG GGTCGGCGAG GGCAGCGCTG CTGGACCGGA CCGAGTTCAC CCAGCCCGCG
60481  CTGTTCGCGC TGGAAGTGGC GCTGTTCCGG CTCGTGGAGT CGTGGGGAGT GCGCCCCGCG
60541  TATGTGCTGG GCCACTCGAT CGGCGAAGTG GCCGCGGCCC ATGTGGCCGG GGTCCTGTCC
60601  CTGCCGGACG CCTGCACATT GGTACGGGCG CGCGGGCGGC TGATGCAGCG ACTCACCGCG
60661  ACCGGGGCGA TGGTCGCGGT GGAGGCGGCC GAGGACGAGG TGGCGCCGCT GCTCGCGGGG
60721  AAGGAGCACA AGGTCTCCAT CGCCGCGGTC AACGGCCCGA CCTCCGTGGT CGTCTCCGGT
60781  GACGAGGACG TGGTCACGGC GGTGGCGGAG ACGCTGGCGC GGCAGGGCCG CAAGACCAAG
60841  CGGCTCGTGG TCTCGCACGC CTTCCACTCC CCGCACATGG ACGGGATGCT GGACGCGTTC
60901  CGCGAGGTGG CGTCCCGGCT GACCTACGCG CCGCCACGGA TACCCGTGGT GTCGAACCTC
60961  ACCGGCACGG TCGCCGAACC CGGGGAGCTG TGCTCCCCCG AGTACTGGGT ACGGCATGCG
61021  CGGGGCGCGG TGCGGTTCCT CGACGGTGTC CGCACACTGG CCGATCAGGG CGTGCGCACC
61081  CATCTGGAAC TCGGCCCGGA CGGGGTGCTG ACCGCGATGG GGCAGGACTG TCTGCCCGAG
61141  GCGGACGCGG CGTTCGTGCC GTCCCTGCGT CCGGGTGTCC AGGAGCCCCA CGCGGTGCTG
61201  GCCGGGCTCG CCGGGCTGTA CGTACGGGGT GTACGGGTGG ACTGGGACGG GATGTTCGCC
61261  GGGTCCGGCG CCCGGCGCGT CGCCCTTCCC ACGTACGCCT TCCAGCACGA GCACTACTGG
61321  CTGGAGCGGG CCGCCGGATC CGGTGACGTG GGCGCGGTGG GGCTCGGGGA GGCGGGCCAT
61381  CCGCTGCTGG GCGCGGTGGT GCAGCTCCCG GAGACGGGCG GGGTGCAGCT CAGCGGGCGG
61441  CTGTCGGTAC GGGCCCAGCC CTGGCTGGGC GAACACGTCA TCTCCGGGGC GGTGCTGGTG
61501  CCCGGCACGG CCATGGTGGA ACTGGCCGTC CGCGCCGGGG ACGAGACCGG CACCCCGGTG
61561  CTGGAGGAGC TGGTGATCGG GCAGCCGATG GTGCTGCCCG GCGACACCGC CCTGAGCGTC
61621  CAGGTCGTCG TGGGCGCGGA CGAGGGCGGG CGGCGTACGG TGCGGATCTA CTCCCGTACC
61681  GACGGGGGCA GCGACTGGAC CGAGCACGCC ACCGGCACAC TCGCGGCGCA GGGCCCGGCA
61741  CCGCTGGACG GGGCGCGTA CGGAGCCGGG GACGGGGCCG CCGTCCAGTG GCCGCCCGCG
61801  GAAGCCGAGC CGATCCCGGT GGAGGACTTC TACCGCTCGC TCGTCGACGC CGGATACGCG
61861  TACGGTCCGG CGTTCCGTGG GCTCGTCGCC GCGTGGCGCC GGGACGGTGA GATCTTCGGC
61921  GATGTGGCGC TGCCGGAGGC GTCCGTCGCG GAGGCCGAAC GGTTCGGCAT CCACCCGGCG
61981  CTGCTGGACG CCGCGCTGCA CGCGGGCAGC TTCTGCCTGC CCTCGGACCC GGCGCGACAG
62041  GTGACCTTGC TGCCGTTCGC CTGGAACAAC GTGCGTCTGC ACGCGGGCGG CGCGTCCGCG
62101  GTCCGGGTGC ATGTCCGCCC GGTCGGCGAC GACGCCTTCT CGGTACGTCT GACCGACGGC
62161  TCGGGCCAGA CGGTGGCCTC CGTGGACTCG CTCACCCTGC GCGCGGTGGA TCCGGCCCAA
62221  CTGGAGATCG GTACGGCCGA CGACGCGCTG TGGACGGTCC GTTGGAGCGA GACCTCCCTG
62281  CCGGACGGCG CGATCTCCTG GGCCGCGCTG GGCGATCCGG CCACCGGTGG CGCCGGGGCC
```

-continued

```
62341  ATGGGAGACA CCGGAAGCGC GGGAGGCGCC CTTCCCGACG TCCTCGTGGC CGATACGCGC
62401  GCCTGGGCCG AAGACCTCAC CGGGCCGCCG ACCGCGCGGG CCCGCCGGCT CACCGGCCGC
62461  CTGCTGGCGG AGATCCAGCG GTGGGTCGCC GACGACGCGA TGGCCGGGAC CCGGCTGGCC
62521  GTGGTCACCC GCGGTGCGGT CGCGGTGCGC GACGACGCCG AGGTCACCGA CCCGGCCGCC
62581  ACCGCGGTCT GGGGCCTGGT CCGCTCGGCC CAGGCCGAAC ACCCGGGGCG GGTGGCCCTG
62641  GTGGATGCCG ACGGGGTGTG CGAGGAGCTG CCCGCCGGGG TGTGGTCCGG GGAGGAGCCC
62701  CAACTGGCGG TGCGCGGTGG CGCCGTGTGG GTGCCGCGCC TGGCCCGGGT CGAGCCCGGT
62761  CTGCGCGTGC CCGCGCAGGC GTCGTGGCAT CTGGACTCGG CCGACTACGG CACTCTGGAC
62821  CATCTGGCGC TGCTGCCCGA CGAGGCCCAG CCCGCACCGC TGGAAGCGGG TCAGGTGCGG
62881  ATCGAGGTCC GCGCCGCCGG GCTCAACTTC CGGGATGTCC TGGTGGCTCT CGGCATGTAT
62941  CCGGGCCGGT CGGTGATCGG CACGGAGGGC TCCGGTGTGG TGACCGAGGT CGGTCCGGGC
63001  GTCGCGGAGC TGGCCGTGGG CGACCGGGTG ATGGGCCTGT CTCCGGGCTC GTTCGGGCCG
63061  CTGGCCACCG CCGACGCGCA TACGGTGATC CGGATGCCGG ATGGCTGGTC GTTCGGCACG
63121  GCGGCCGGGG TGCCGGTGGC CTATCTGACG GCGCTGTACG CGTTGCAGGA CCTCGGGAGC
63181  GTTCAGCCGG GCGAGACGGT CCTGGTGCAC GCCGCCGCGG GCGGTGTGGG CATGGCCGCC
63241  GTCCAGCTCG CACAGCACTT CGGCGCCACC GTCCTGGGCA CCGCCCACCC CTCCAAGCAC
63301  CACGCACTCC ACCGGCTTGG CGTGCCCGCC GAACGGCTCG CCTCCAGCCG CGACCTCGGC
63361  TACGCCGCCG CCTTCCCCAC CGCCGACGTC GTGCTCAACT CCCTCACCGG CGAGCACATC
63421  GACGCCTCTC TCGGACTTCT CAATCCCGGC GGCCGGTTCC TGGAGATGGG CAAGACCGAC
63481  CTGCGGGAGC CCGGCGAGGT CGGGGCACGG CATCCGGAGG TCACCTACCG GGCGTTCGAC
63541  CTCGGCGGGG AGGCCCCCGC GGAGCGGGTG CGGGAGTTGC TGCACCAGTT GGTGGAGCTG
63601  TTCGAGGCGG GCCGGATAGA GCCGCTTCCG GTGCGGCAGT GGGACATCAC CCGCGCCCCC
63661  GAGGCGTTCC GCTGGATGAG CCAGGGGCGG CACACCGGCA AGATCGTGCT CACCCTCCCC
63721  CGCGCCCTGG ACCCGGACGG CACCGTCCTG GTCACCGGCG GCACCGGAAC CCTCGGCGCC
63781  ACCGTCGCCC GCCACCTCGT CACCCAGCAC GGCGCACGCC GACTACTGCT GGTCAGCCGC
63841  CGGGGACCGG ACGCACCCGG CGCCACCGAC CTCACCACCG AACTCACCGA ACTCGGCGCC
63901  ACCGTCCACA TCACCGCATG CGACACCGCC GACCGCGACC AACTCGCCAC CACCCTCGCC
63961  GACATCCCGG CCGACCACCC CCTCACCGCC GTGGTCCACA CGGCCGGGAC GCTCGACGAC
64021  GGCATCCTCA CCGCACTCAC CCCGGACCGC CTCGACACCG TCTTCCGCCC CAAGGTCGAC
64081  GCCATCACCC ACCTCCACGA CCTCACCCGC GACCAGGACC TGGCCGCGTT CGTGGTGTAC
64141  TCGTCCGCCG CCGGAGTCCT CGGCGGACCC GGCCAGGGCA ACTACTCCGC CGCCAACGCC
64201  TATCTGGACG GCCTCGCACA GTGGCGGCGT GCGCACGGGC TCCCCGCCAC CTCGCTGGCG
64261  TGGGGCATGT GGGCGCAGAC CAGTGGCATG ACGGCCGGGC TCGGCTCAGG GGATCTGCAC
64321  CGGGTGCGGC GTGGCGGCAT CGTCGGGCTG TCCACGGCGG AGGCGCTGGA CCTGTTCGAC
64381  CGGTCGGTGG CGTCCGGGCT GTCCCTGCTG GTGCCGTTGC GGTTCGACCT CGCCGCCCTC
64441  GGTGCGGAGG CCGCGGAACC GCCGCCGCTG CTGCGGGGGC TGGTCCGGCC GGCCCGGCGT
64501  ACGGCCCGGC CGGTGCCGAA GGCCGGTGAG GGCGGCCTCG TCGAGCGGCT GGCCGGTCTT
64561  TCGGCGGCCG AACAGGAGCG TCTGCTGGTC GAGTTGATCC GCGAACAGGC CGCTTCCGTG
64621  CTCGGGTTCC CGACCGTCGA CCCGATCGGG CCGGAGCAGG CATTCCGCGA TATGGGGTTC
64681  GACTCGCTGA CCGCGGTGGA GCTGCGCAAC CGCCTCAACA CGGCCACCGG ACTACGGCTC
```

-continued

```
64741 CCGGCGACGC TGGTCTTCGA CCACCCGACC CCCTTGGCCA CCGCCGAGCT CCTACGGGAC
64801 GAACTGGGCG GGCGCGCGGT CGAGGCCACG CCCCGCCCGG CCCGGCGCGA CCGGTCGGCT
64861 CCGGACGCGG CCGAGGATCC GGTCGTCGTG GTCGGCATGG GCTGCCGCCT GCCCGGCGAC
64921 GTCCGCACCC CCGAGGACCT GTGGCGGCTG GTCGCCGCCG GAACCGACGC GATCGGGCCG
64981 TTCCCGCAGG ACCGGGGCTG GGACCTGGCC GGGCTCTTCG ACTCCGACCC GGACGCCCTG
65041 GGCAAGTCCT ACGTCCGCGA GGGCGGCTTT CTCACCGACG CGGGCGGCTT CGACGCCACG
65101 TTCTTCGGCA TCTCCCCGCG CGAGGCCCTG TCGATGGACC CGCAGCAGCG TGTCCTGCTG
65161 GAGACCGCGT GGGAGACCCT GGAACGCTCC GGGATCGTTC CCACGTCACT GCGCGGACAG
65221 GAGGTCGGGG TCTTCGTCGG GGCCAGCGGC CAGGGGTACG GCACCGGTCC TGGCGCGGCT
65281 CCGGAAGGCT TGGAGGGCTA TCTGGGGGTG GGCGGCGCGA CGAGTGTGGC GTCGGGCCGG
65341 TTGTCGTACA CCTTCGGCCT GACCGGTCCG GCGGTCACGG TGGACACGGC GTGCTCCTCC
65401 TCCCTGGTGG CCCTCCACCT CGCGGCACAA GCTCTGCGCT CCGGCGAATG CACGATGGCA
65461 CTCGCGGGCG GTGTCGCGGT GATGGGCCAG CCCGGCGCAT TCGTCGAGTT CTCCCGCCAG
65521 CGCGGTCTCG CGTCCGACGG CCGCTGCAAG TCCTTCGGCG AGGGCGCCGA CGGCACCAAC
65581 TGGTCGGAGG GCGCGGGTCT GGTGCTGCTG GAACGACTGT CCGACGCCCG CCGCAACGGC
65641 CATGAGGTGC TGGCCGTGAT CCGTGGCACC GCGGTGAACC AGGACGGGGC GAGCAACGGC
65701 CTCACCGCTC CGAACGGGCC CTCCCAGCAG CGAGTGATCC GGCAGGCCCT GTCCAATGCC
65761 GGGCTCACAG TGGCCGACGT GGACGCGGTC GAGGCACACG GCACCGGCAC CGCCCTCGGC
65821 GACCCCATCG AGGCACAGGC ACTGCTCGCC ACCTACGGCC AGGACCGCCC GGGGGACGAA
65881 CCCGTGTGGC TGGGCTCGCT GAAGTCCAAC ATCGGCCACA CCCAAGCGGC CGCAGGCATA
65941 TCCAGCGTCA TCAAGATGGT CCTGGCGATG CGGCAGGGCA CGCTTCCCCG GTCCCTGCAC
66001 GCCGACGAAC CCACCACCCA GGTGGACTGG ACGTCGGGCG CGGTGTCCCT GCTGACCGAG
66061 GCACGGCCCT GGCCGGAGAC CGGACACCTC CGCCGCGCCG GGATCTCCTC CTTCGGCGTC
66121 AGCGGGACAA ACGCACATGT GGTCCTGGAG CAGGCCCCGG AAGCGGCCGC ACCGCAGGCG
66181 GACGAGGCCG ACGACATCCC TGGTCTGGTC GCCACCGGCG GGATCGCGCC CTGGGTCCTG
66241 TCGGCCAAGA CCCCCACGGC CCTGCGGGCT CAGGCCCAAC GCCTCCTGGA CCACCTGGAA
66301 TCCGGGGTGG ACGGCCGCCC CCTCGACATC GGCTGGTCCC TGGCCACCAC CCGCACCCTC
66361 CACGACCATC GCGCCATAAT CCTCACCGAC ACCGACACCG ACACGCGCGC CGAGGGCGGT
66421 GAGGCCACGG CCGCCCTGAC CGCCCTCGTG ACCGGACAGC CGCATCCCCG CCTCACGACG
66481 GGCTACGCCA CCACCCAGGG CAAGACCGTG TTCGTTTTCC CGGGGCAGGG GTCGCAGTGG
66541 GTGGGGATGG GGGCACAGCT CCTGGACACT TCGCCCGTCT TCGCGGCCCG GTTGCGCGAG
66601 TGTGCCGACG CGCTGGCCCC GTATACCGAC TGGTCCCTGA TGGACGTCAT CACCGGCGCA
66661 CCCGATGCCC CTTCGCTCGA CCGTGTCGAC GTCGTACAGC CCGCCACCTT CGCCGTCGTC
66721 GTCTCCCTCG CCACCCTCTG GCAATCCATG GGTATCCACC CCGACGCCGT CACCGGCCAC
66781 TCCCAAGGCG AAATCGCCGC AGCCTGCGTC GCCGGACACC TCACCCTCAC CAACGCCGCC
66841 AAAATCGTCG CCCTGCGCAG CCAGATCATC GCCGACCACC TCGCCGGACA CGGCGGCATG
66901 ATGTCCCTCG CCACCCCCGC CGACACCATC GACCTCACCA ACTGGCACGG CAAACTCTGG
66961 ATCGCCGCAC ACAACGGCCC CAACGCCACC GTCATCGCAG GCGACGCCGA AGCCCTGCAC
67021 CAACTCCACG CCCACTACAC CGACCAAGGC ATCCGAGCCC GCATCATCCC CGTCGACTAC
67081 GCCTCCCACA CCGGACACGT CGACACCATC AAGAACGAAC TCCACCAAAC CCTGGCCGAC
```

```
                                               -continued
67141  ACCACCACCG AGCCCGGCAC CCTCCCCTGG CTCTCCACCG TCGACGGGGA GTGGATCGAA

67201  CCCAACACCC TCGACAGCAC CTACTGGTAC CGCAATCTCC GCCAGACCGT GCAGTTCCAC

67261  ACCGCCATCA CCACCCTCGC CGACCAGGGC TACCGCACCT ACATCGAAAT CAGCCCCCAC

67321  CCCGTCCTCA CCACCGCCAT CCAAGAAACC CTCGAAACAC ACAACACCCC CAACGCGATC

67381  GTCACCGGAA CCCTCCGCCG CGACGACGAC ACCCCCACCC GCCTCCTCAC CAACCTCGCC

67441  CACCTCACCA CCCACGGAAC ACCCGTCAAC TGGCCCACCC TCTTCACCCG CACACACCCC

67501  ACCCGCATCA CCCTCCCCAC CTACCCCTTC GAGGAGGACA CGTTCTGGCT GGACCGCAGC

67561  GGCCCGGGTG ATGTCCGTGC CGTCGGCCTG GAGGACACCG GCCATCCGCT GGTCGGGGCC

67621  GTGGTGAGTG TGCCCGACAC CGACGGTGTG CTGCTCACCG GCGGCTCTC CCTGACCACC

67681  CACCCCTGGC TGGCCGACCA TGCCGTCTCC GGCACCGTCT TGCTTCCCGG TACGGCGATG

67741  GTGGAGCTGG CGGTGCGAGC CGGAGACGAG GCGGAGGCCC GCGTACTGGA GGAATTGATC

67801  ATCAGTCGGC CGATGGCGGT GCCGGACGAG GGAACCTTGC ACGTCCAAGT GCTGGTCGGC

67861  GGCGAGGAAG GCGACGAAGG CGGACGCCGC AAGGTGGGGG TCTACTCCCG CCCCGAGGGC

67921  ATACGGCAGT GGACCGAGCA CGCCACCGGC ACACTGCTGA CCGGGGGAAC CGCCACCGCG

67981  GCGGCCACGA CAGCGCATCC GTGGCCGCCC GAGGGGGCCG AACCCGTCGC CCTCGAGGGG

68041  TTCTACGAGC AACTGGCCGA GGCGGGGTAC GAGTACGGCC CGGCGTTCCG GGGCCTGAGC

68101  GCGGTGTGGA AGCGGGACGA CGAGGTGTTC GCCGAGGTGG CCGTGCCGGA GGACCAGACC

68161  GCGGTCGCCG GACGGTTCGG CATCCATCCG GCGCTGCTGG ACGCCACTCT GCATGCCGGG

68221  AACTTCTGCT TCGAGTCCGG CGGCGACCGG CCCACGATGC TGCCGTTCGC CTGGACCGAC

68281  GTGCGGCTCC ATGCCGTGGG CGCCACCGCT GTACGGGTGC GGGCGACGGC GTCCGGCACG

68341  GACGGGCTGT GTGTGCAGAT CACCGATCCG CACGGACTGC CGGTCGCCAC CATTGGCTCG

68401  CTCCAGCTCC GGGAGACCAC ACCCGAGCAG TTGCGGGCCC TCTCCGCCAC CTCAGGTGGC

68461  AATGCCTTGT GGGCGGTCGA ATGGGCCGAA TGCGGGCTCG ACGACACGAC GGAAGCACAG

68521  TGGGCCACAC TCGGAGAGAG CCAACTCCTG GACTCCCCAC TTCACTATGC CGATGTTTCC

68581  CAGGTCGTGG CGGCCGGGGA ACAGCCCGCG GCACTCGTCG CCGACGTGTC CGCATGGGCT

68641  CCCGAGAACA CCGGGCCGCC CATCGACCGC GCCCACGCGC TCTGTGCCCG AGTCCTCGAT

68701  CTGCTGCGGC AATGGGTGGA CCGGCCCGAG CCGGCGGACA CCCGGCTGGT GATCCTGACC

68761  CGCGGTGCCA TGGCGGTCCA CGACACCGCC GAGGTCACGG ATGCGGCCGC CGCCGCGGTC

68821  TGGGGCCTGG TCCGCTCGGC CCAGTCCGAA CACCCGGGCC GGATCCAGCT CATCGACATC

68881  GACGAGCACT CCCACCGCAC CCTGCCGACA GCACTCACCA CCACCGACCA ACCCCAACTC

68941  GCCCTCCGCG ACGCCACCGC CTACACCCCC CACCTGGCCC CCGCGCCCAC CCCAACACCC

69001  GGGCCCCTCA CCCTCGCGCC CGAGGGAACC GTCCTCATCA CCGGCGGCAC CGGCACCCTC

69061  GGCGCCCTCA CCGCCCGCCA CCTCATCACC CACCACAAGG CACGCAACCT CCTTCTGGTC

69121  AGCCGCCAGG GTCCGGACGC CCCCGGCGCG GACCGGCTGA GCGAGGAGCT GACCCAGCTC

69181  GGTGCCCGTA TCCGCATCGC CGCCTGCGAT GTCGCCGACC GCGACCAGCT CGCCACCGTC

69241  CTCGCCACCA TCCCCGCAGA CCAGCCGCTG ACCGCCGTCA TCCACACCGC CGGCGCCCTC

69301  GACGACGCCC TGCTCACCGA CCTCACCCCG GAACGCCTGG GCACCGTCTT CCGCCCCAAG

69361  GTCGACGCCC TCACCCATCT CCACGACCTC ACCCGCGACC ATGACCTCGC GGCCTTCGTC

69421  ATCTACTCCT CCGCCACCGG TGCGCTCGGC ACCCCCGGTC AGGCCAACTA CGCCGGCGGCC

69481  AACACCTACG CCGACGCGCT CGCCCAGCAG CGCCACGCCG CCGGGCTCCC CGCCACCTCA
```

-continued

```
69541 CTCGCCTGGG GCCTGTGGGA AACCACCAGC GCCCTCACGG CCGGGATGTC CACCACCCAT
69601 CAGCAGCGCA CCCGCCACAG CGGTGTCATT CCCCTGACCG ACGCCGACGG CATGCGCCTC
69661 CTCGACACCG CGCTCACCAC CCACCAGCCC CACCTGATCC CCCTCAAGCT CGATCGCACC
69721 GCCCTCCGGA ACAGCGCCGC CTCCCACACC CTCCCGCCCC TGCTCCGCAC CCTGGCGCAA
69781 AGCCACCACC GCCCCACCGC CCACACCACC CCCCGGACCG CCGCCGCCCC GCCCCTCCCC
69841 GAGCAACTCG CCGCCCTCGA TCCGGCCCAG CGGCTCCAGC ACCTCACCGC ATTCGTCCGC
69901 GCCGAAGCCG CGGCCGTGCT CGGACACGCC ACTTCGGACG CGGTGGGACC GGACGATCCG
69961 CTCTTCGAGA TCGGGTTCGA CTCCCTGACC GCGGTGGAAC TGCGCAACCG GCTCAACGCG
70021 GCCACGGGCC TCCAGCTCCC GGCGGCGTTG CTGTTCGACC ACCCCACCCC GGCGATGGCC
70081 GCCGAACACC TCCAGGAACA GCTCGCGCTG AAAGACGCCT CCTGAGGACG CCTCCTGAGA
70141 CGGACAACAG CGTCCCCGGC CGCCGTGGCG GCCGGGACG CTGCCGTAGG GCGCTCCCCC
70201 GCCCTCCTCA CCAGGCCGCC GCCGTACGCC GTGCAACATG ACTGGTCCCT TCCCCCGGTT
70261 TCTTTGGGGA AGGGACCAGT TTCACTGACG GGTTCCACGG CCCGGCGGCC GTCGCTCGTT
70321 AGGTGTCCGA GGTGACGCTC TCCCCGGCCC GGGCCGCGCG GCGGCGCTCG TCGCCCGCCT
70381 TGATCAGGGC GTACCTGATG GCCAGCGCCG CCGCGTTGAC CGCGTGCAGC GCCTCCTGGG
70441 CGGCGGAGTC CGGCTGTTGC TGTCCGGTGG CGGCGGCCGA GGTGGACTGT GCCGCCTCCA
70501 GGCAGGCGAC GCACGCCTCC ACGAGGGCGT CCGGCCGCCC GCCGGCCCGG CCCAGCTCCG
70561 TCAGCAGCCG GGTGATCTCC CGGTGCACTT CGCCGATCGG GTCCGCCACC ATCGGATCAG
70621 CCACCCTCGA GTCAGCCATC CTCGGGTCCG CCGCCATCGG GTCAACGCCC CGCGCACCG
70681 TCGTCCGCGG GCCCGTGGCC CGTCGGGAGG TCCCCGGCCG GGCCAGGGT GAGGAAGCGC
70741 TGCTCCCACA GGGCGAACAC CTCGGTGGCC AGTGCCTCCG AGAGTCCGCC GACGGTCTTG
70801 GCCAGATCCC CGAGGGTGGT GGTGCCGTCC ACCGCGCCGA GCAGTTCGTA CAGCTCGGGC
70861 GAGACCTTCG CGGACGGGCC GCCGTCGTAG TCGAGGTGCA TCTCGTGGGT CCTGGCTCCC
70921 GCCGAGGCGT CCGGACCGGC CGTCCTGCGC TCGACCAGCC GGGTCACCGG GCGGAACCGC
70981 GGCACCAGAA CGCCCAGGTC AGGCGCGGGT TTGCCGCGTA CCAGGCAGTC CTCCACCACC
71041 AGGACGTCCA GGTCGGTGGT CAGGAAGCTG GTGACCACGT CGTCGAGGCT CTGCACGATG
71101 GGTTCGGCGT TGTTGTTGAA GGAGGTGTTG AGGAGCACGG GGGTGCCGGT CAGTTCGCCG
71161 AACCGCCGCA CCAGGCGGTG GAACCGCTCG CCCGATTCGG CGGAGACGAC CTGCACCCGG
71221 GCGGTGCCGT CCACGTGGGT GACCGCGCCC AGTTCCGTAC GCCGCTCCGG CAGCACCGGC
71281 ACCACGAAGG ACATGAACTC GTGGTTGCCG TCCGCGCCCG AGAGGTCGAA GTAGTCGCGG
71341 GCGGCTTCGG CCGTGACCAC CGGGGCGAAC GGCCGGAAGC CCTCGCGCTT CTTCACCATC
71401 GCGTTGATGC GGGTCCGGTT CTCCTCGGGG CGGGCGTCCG CGACGATGCT GCGGTGGCCC
71461 AGGGCGCGGG GGCCGAACTC GGAGCGGCCG TACGCCCAGC CGAGCACCTG TCCCTCGGCG
71521 AGGAGTCCGG CCGCCGTCTC CACGGCCTCG TCCGGGAACT CCACATCGAT CAGCGGCGCC
71581 CAGTCGGCCA GCCGGGCCCT GATCTGCTCC CGGCCGCCCA TTGCCGGGCC GAGACTCGCG
71641 CTGAGCAGCC GTTTGCTCGG CCGCTCCAAC GTGCCGAGGC TCGCCGCGGC GGCGTAGGCG
71701 GCGCCCTCGC CCGCGCCCGC GTCGTGCGAG GCGGGGTGCA CGAACACCTC GTCGAAGAGC
71761 CCGGACTTGA GGATCAGCCC GTTGAGGCTG GAGTTGTGGG CGACGCCGCC GCCGAAGCAC
71821 AGGCGGGACT GGCCGCTGGT CTTCGCCCAG TATTCGAGGA TGTGCAGCAC GATCTTCTCG
71881 ACCGTCTCCT GGAGCGCGGC GGCGAAGTCG CGGTGGGCCT GGGTGAACGG CTCGCCCTTG
```

-continued

```
71941  CGGCGCGGCC GGAAGCCCTC GGCGTAGAAC AGCGGGCTGA CCAGGTTCGG CACCATGATG

72001  TTGCCGTGCA ACTCGTACTC GCCGTTGTCC TGGAGGGTGT AGAGCTTGGC GAAGGTGTCG

72061  CGGTAGGTCT CGGGCTTGCC CCAGGGGGCC AGGCCCATCA CCTTGTACTC GTCGCCGAAG

72121  CCGTAGCCGA GCAGATAGGT GGCGTTCAGA TAGAGCCCGC CGAGCGACTT GGGCACCGGG

72181  TAGTCGGCCA GCTTCTCCAG GTGCGTGCCC TCGGCGCGGT AGACGGTGCC GGAGTGCAGT

72241  TCGCCGCGGC CGTCCAGCAC CAGGACCACT GCGGAGTCCA TGCCGGAGTG CAGATACGAG

72301  GAGTACGCGT GCGCCTCGTG GTGCGGCACG TACACCAGCT TCTCGTCCGG CAGGTCCCAG

72361  CCCAGGCCCT CCTTCAGCCG CTGCCGGATC AGCTCCCGGG AGTAGCGCAG GGGGGCCCGC

72421  GGATATTCGG TGTAGAGGTG GTTGAGGACG GTGTCGATGT GGTTCTCGGG GAAGTAGTAG

72481  CCCACCGCGT CGACGTCCTC GGGCCGCGCA CCGGCCAGGG CCAGGCACTC ACGGACCGCG

72541  TTGAGGGGAA ATTTGGTTGT CTTCTTGATC CGGTTGAGCC GCTCCTCCTC CACGGCGGCC

72601  ACGAGTTCGC CGTCGCGGAT CAAGGAAGCC GCCGAGTCGT GAAAGAACAC CTCGCCGAGT

72661  TGCGGCACCA CATCGGTGTC CGCGGCGGAG AAGTTGCCGT TGAGCCCGAG CACAAGCACA

72721  GTGATCACCC AAACCAGTCG GAGGCGAACG CGAGGATGCG GGGCGGAAGA CGCCCGCCGG

72781  TCACCGGGAG CGCGGCAGCG CCGGGTCGGC CAGCTCAGGC GCCGTCAGCC GCAGCGTCGT

72841  CGGGGCCGGC TGGAACGCGG GGGTGAGGTG GAGGCGCTCG ACCCCCTCCT CGTCGGGGGC

72901  CGCGAGCGCG GCGGTGCACG CGGCAGGTGGT GTCGGCGAAC CCGGCGAAGC GGTAGGCCAC

72961  CTCCATCATC CGGTTGCGAT CGGTGCGCCG GAAGTCGGCG GCCAGGTGCA CCCCGGCCTG

73021  TGCCGCCTGA TCGGCCAGCC AGTTCAGCAG GGTGGACCCG GCGCCGAAGG ACACCACCCG

73081  GCAGGAGGTG GCGAGCAGTT TCAGATGCCA CACCGCGGGG TGCCGTTCCA GCAGCACGAT

73141  GCCGACGGCG CCGTGCGGGC CGAACCGGTC GGCCATCGTG ATGACCAGCA CCTCGTGCGC

73201  GGGGTCGGTG AGCAGTCCGC GCAGTACGGA GTCGGGGTAG TGGACGCCGG TGGCGTTCAT

73261  CTGGCTGGTG CGCAGGGTCA GTTCCTCGAC CCGGGACAGC TCCCGCTCCG TGGCGCGGGA

73321  GATGCCCATC CGTATGTCCA GGGTGCGCAG GAAGTCCTCG TCGGGGCCGC TGAACTCGGC

73381  CCGCTCGGCG TCACGGCGGA ATCCGGACTG GTACATGTTC CGGCGCTGCC GGGAGTCCAC

73441  GGTGACCACG GCGGGCTGA ACTCGGGCAG CCCGGTGAGC CCGGCCAGGT CCTCGGCCGG

73501  GTAGCAGCGC ACCTCGGGGA GCCGGTAGGC GACCTCGGCC CGTTCGGCGG GCTGGTCGTC

73561  GACGAACGCC ATGGCGCGGT CGGCGAAGTT CAGCCGGTCC GCGATGGCGC GTACCGACGC

73621  GGACTTGGGG CCCCAGCCGA TATGCGGCAG TACGAAGTAC TCGGCGAGGC CGAGGGCCTC

73681  CAGGCGCTCC CAGGCGTGGT CGTGGTCGTT CTTGCTGGCG ATGGACTGGA GAATGCCGCG

73741  TTCGTCGAGG GTGGTGATGA CATCGCGCAC CCACTCGAAG GCAGCACCT CGCCGTCCTC

73801  GAGCAGGGTG CCGCGCCACA GTGTGTTGTC CAGGTCCCAG ACGAGACATT TGACGGCCGT

73861  CGGCGGCTCG CTCACGGGCT TCCCCTCCGT CATGCTTGCA CCTTCTTCCG CGTGTGCTGG

73921  GCGAGGACGA GCTGGCAGAT CTCGCTGGTG CCCTCGATGA CTTCCATCAG CTTCGCGTCG

73981  CGGTACGCCC GGGCCACCAC ATGGCCGTCG GATGCGGCGG CCGACGCCAG GAGCTGTACG

74041  GCGCGTGCCG CGCCGTCGGC CGCCTCGCGG GACGCGACGT ACTTCGCGTG CACCGCGTCG

74101  ACCGCCATAT CGGGCGAGCC GGTGTCCCAG GAGGCGCTGG CGTGTTCGCA GGCCCGGGTG

74161  GCGTGCCGCT CCGCGACGTA CAGCTCGGCC AGGTGCCGGG CCACCAACTG GTGCTCGGCG

74221  AGTCTGCGGC CGGACTGTTC CCGGGTGGCG GTGTGCGTGC CGGCGGCGTC CAGGCAGGCG

74281  CGCAGGATGC CGACGCACCC CCACGCCACG GACATGCGCC CGTAGGTGAG CGCCGCGGTG
```

-continued

```
74341 GTCACCAGGG GCAGTGGCAG TCCGGTGCCG CCGAGTACCT GGCCGGTGGG CACCCGGACG
74401 GCGTCCAGGG TGATGTCCGC GTGGCCGGCG GCGCGGCAGC CCAGCGGGTC GGGCACCCGC
74461 GTGATGCTGA CTCCGGGGGC CCGGGCGGGC ACGACCACGG CCGCGGCGCC GCCACGATAT
74521 TTCCCGAACA CCACCAGCAG ATCGGCGTAG TGGGCGGCGG TGATCCACAC CTTGCGGCCG
74581 GTGACGACCA CGTGTGTGCC GTCATCGGCG ATCTCGGTCT CCATCGCGGC CAGGTCGCTG
74641 CCCGCCCCCG GGCTGCTGAA TCCGACCGCC GCCAGATCAC CGGAGGTCAG CCGGGGCAGA
74701 AAGGTGGACC ACTGTTCCGC GCCACCCAGC CGCCGTACGG TCCACGCCGC CATGCCCTGG
74761 GACGTCATCA CGCTGCGCAG CGAGCTGCAC CGGGCGCCGA CCGCCGCGGT GAGCTCCCCG
74821 TTGGCACGGC TGTCCAGTCC GGCGGCGCCG TGCTCGGCGC CGACCTGCGC GCACAGCACA
74881 CCGGAGGCGC CGAGTTTGAC CAGGAGGTCG CGGGGCAGCT CCCCGGCCAG GTCCCAGGCG
74941 TCCGCCCGGT CCCCGATCAA CCCGCTGACC AGCTCCGTAT GGCTGGTGGC GGCGTCGGTC
75001 ACGGCTGTAC CCCGCGCAGC CGCAGGACCA TCGCGGTCAT CGCGTTGACC GTGCGGAAGT
75061 TGTCCAGCGC CAGGTCGGGG CCGGTGATCA CCACGTCGAA GGTCGACTCC AGGTGCACGA
75121 CCAGCTCCAT GGCGAACATC GAGGACACGG CACCGGAGCT GAACAGATCG GTGTCCGGGT
75181 CCCAGGTCTG CTTGGTGCGC TGTTCGAGGA ACTGCTGCAC CTCCTGCGCC ACCGTCTCGG
75241 CGGTGTGGCT GCCCGGCTCG GATGAGATGG TCACGCCAGT TCCTTCCCGT ATGCGTAGAA
75301 CCCGCGGCCC GACTTGCGGC CCAGGTGGCC GTCGCGGACC TTCTTCAGCA GCAGTTCGCT
75361 CGGCGCGCAC CGGGAGTCGC CGGTGCGCTC GTGCAGCACG CGCAGCGAGT CGGCCAGGTT
75421 GTCCAGGCCG ATCAGGTCCG CGGTGCGCAG CGGCCCGGTG CGGTGGCCCA GGCAGTCCCG
75481 CATGAGTACG TCCACGGCCT CCACCGTGGC CGTGCCCTCC TGCACCACCG GGATCGCGTC
75541 GTTGATCATC GGGTGCAGCA CCCGGCTGGT GACGAACCCC GGCCCGTCGC CGACGACGAC
75601 CGGCTTGCGC TCCAGCGCAC GCAGCAGATC CGTCACGCG GTCATCACCG CTTCCCCGGT
75661 CCGGGGACCG CGGATCACCT CCACCGTGGG GATCAGATAG GCGGGTTCA TGAAGTGGGT
75721 GCCGACCAGC CGTGCCGGAT CGGCGATATG ACCGGCCAGT TCGTCGATCG GGATGGAGGA
75781 GGTGTTCGAG ATCAGCGGCA CCCGCGCTCC GGTGAGCCCG GCGACCGCTT CGAGCACCTT
75841 GGCCTTGGTG GGGGTGTCCT CGGTGACGGC CTCCACCACC GCGGTGGCGT TCCGGCCGTC
75901 GGCCAGGGAC GCGGTGACCG TCAGCTCGCC CCGCGGGCGG CCGGCCGGCA GGGCTCCCAT
75961 GAGCTGCGCC ATGCGGAGCC GTTCGGTGAC CGCGGCCCGT GTTCGGCCGG CCTTGGCCTC
76021 GTCCACCTCG ACGACCGTCA CCGGGATTCC GTGCCCGACG GCGAGAGAGG TGATTCCCAG
76081 TCCCATCGTT CCTGCGCCCA GCACCGTGAG CCGCGGCGCT TCCGCATCTC CGCTCATCAA
76141 TCGCCTCCGC AGCGCGTTGT GAACAACGTG CCGACCATGA CACGCGCTTC CGCGTTCACG
76201 GTATTGTCCG GGCGGTCACC CAAATCCCCT AAGGATCCCC CCTATACCCC CCTCAGCCGG
76261 AATATGAGTT CCAGCATTCT GGAAGACGCC ATTGCGCGGC GCGTCGACGG ATTCTTAGCA
76321 TGGGCCGCAT TGCCTTTCCC TGGTCCTTCC CTTTTCAGCT TTGCGGGGTG CGGAAATCCG
76381 ATGGCTCAGC AAGTCGATGT GACCGAAAAA ATTCTCGGAT ATGTCCGGGA ACTGTCCCTG
76441 CGCGATGACG AGATCCTGGC CGGGCTGCGG GCGGAGACCG CGGGTCTGCC CGCCGCCCAG
76501 GCCATGCAGG TGATGCCCGA GGAGGGCCAG CTCCTCGGGC TGCTGGTACG GCTCGTCGGC
76561 GCCCGTTCGG TGTTGGAGAT CGGCACCTTC ACCGGTTACA GCACGCTGTG CATGGCGCGG
76621 GCCCTGCCGA CCGACGGCAC GCTGGTGACC TGCGACATCA CGGCGAAGTG GCCGGGCTC
76681 GGCCGCCCGT TCTGGGAGCG CGCCGAGGTG GCGGACCGCA TCGACGTGCG CATCGGTGAC
```

```
                         -continued
76741  GCCAAGGAGA CGCTCGCCGG GCTGCGGCGG GAGGGCCGGG AGTTCGACCT GGTCTTCATC

76801  GACGCGGACA AGACCGGATA CGCGCACTAT TACGAGGAGT CGCTGGCGAT GCTCCGGCGC

76861  GGCGGGCTCA TCGTCCTGGA CAACACCCTC TTCTTCGGCC GGGTGACCGA CCCCGCCGCG

76921  CAGGACGCCG ACACCGCCGC CCTGCGCGAG GTGAACAAGC TGCTCCGGGA GGACGGACGC

76981  GTCGAGATCA GCATGCTCAC CGTTGGTGAT GGCATCACGC TCGCGGTCAA ACGCTGACCA

77041  CGTGGCCGGG GTCCGAACGT CTGACGGCCA TGTTCCGGGA TCCTCCCGGG ACATGGCCGT

77101  CCGCGCGGCT CCGCGGTCAG GCGCGCGGCA CCGCGGTCAC GCCAACTCCA TCCGGTCGGC

77161  GTACAGTTCG GTCGGCAGTT GCTCCCGGTG CTTGATGTCC AGCTTGCGGA ACACCCGGGT

77221  CAGATGCTGC TCCACCGTGC TGGCCGTGAC GTACAGCTTC CCGGCGATCT CCCGGTTGGT

77281  ATAGCCCATG GCGGCCAGCG ACGCGACCCG CCGTTCGGAG TGTGTCAGCC GCTCGATCGC

77341  GGTGTCCGAC TTCGGCGTTG GCCCGGTGGC ATGGCCCTGG TCGTCGGCCG GCAGCCACTC

77401  CTCGTACAGC GACGCCGCGT CGCACATCTT CGCCACATGC CAGGCCCGGC GCATGGTCCG

77461  GCGGGCCTGC TTCTTCTCGC CGAGCGCGTG GTACGCCTGG CTGAGGTCCC ACAGGGTGCG

77521  GGCCAGCTCG TACTTGTCCT CCTGCTCGGT GAACAGGCCC ACCGCCTCGT TGAGCAACTG

77581  CGGCCGCCGC TTGGCCGAAC TGGTGGCCGC CAGAAGGCGT AACGACTGTC CGCGGGCCCG

77641  GGCGCCGTCC GTGTGCGGAC GGCTGAGCTG CTGGTACACC AGGATCCGGG CCTGGTCGTG

77701  GTTGCCCTGC GCCAGCCATG CCTCCGCCGC CCCGATCCGC CACGGCACCG GGTCGCAGCC

77761  GCTGCTCAGC CCCCAGTCGG TGAGCAGTTC GCCGCAGAGC AGGAAGTCCG CGAGCGCGGC

77821  CTGGTGGCGG CCCGCCGCCA GGAAGTAGTG GCCGCGCGCG TACAGGTAGT GCAGCCCGTA

77881  GGAGCTTTTG AACATGGCGT TGGGCACGGT CTGCGCGACA TGGAACCCCG CCTCCTCGTG

77941  CCGCCCCATC CGCGTACACG CCAGGATGAG GGCGCCGAGC GGCAGTCCGA TGGCGACGCC

78001  CCAGGCGCCG GGGGAGGCGT GGGTGAGGGC GGCGCGGGAC TGCTCCGCGG CCTCGGCTAG

78061  GTCACCGCGG CGCAGTGCGA TCTCCGACCT GGCGGCCGAC AGCACCGCCT GCCGCATCGG

78121  GACGTGCGGT CCACCACCGG TCTCGCCGAG CGCACCCTCG CACCAGGCGG ACGCCAGGTC

78181  GTTCCGGCCG CCGTAGACCA GGGCGAGCAG GGCGAACAGC CCCGCCTGCT CATGGCAGGC

78241  CGGGTCGTGT CCGAGCTGAA GTTCGCGCAG CACCTCCTCG GCCCGGCGGA CGGTGTCATG

78301  GGTCTGCCCG CCGGTGAGCA CGTCGGCCAG GACCGTACCG GCCCGGGGCC ACGCCGCCGC

78361  CCGTGTCGCC GCGGCGCCAC CGTGGTGCGG CGGTGCCGCC CGCCGCTCGG CCAGCCAGGG

78421  ATAGGTGCAG GTGAGTGCCG CCTCGATGGC ATGGAGCTGG TCGGTGGCCG CGGGGTCCGC

78481  GCGCAGATGG GCGAGCAGCC CCTCCACCTC GCTCAGTCCC CCCTTCCACA GGAGCTGCAT

78541  GAGCAGGGTG ACGCTGTCGG GGAGGCCGAG CCGGCCGGCC CGGACGGCGC CGTACAGCGG

78601  TGCGTGGTGC CGCGTGGCGG TGGACGGATT GATCTTCCAC TCCGCCTCGG CGAGCTTCGC

78661  CCGCAGGGCG CGCGGCGCT CTTCGTGCGG GCATTGCTCG AAGGACTGCT CCAGTAAGTC

78721  GACGGCGATG GACGCCTCTT CGCCCACCGC CACCTGCTCG GCCACTTCCA GAAGCACCTC

78781  GGCCGACCAC GAGTCGGGGA TCTGCCCGGC CCGCACCAGA TGACGGGCGA TCGTGGCGGC

78841  GGGCCTGCCC TGGTCGTGCA GCAGCCGCGC GGCCCGCTGG TGCAGGGTCC TGCGGGCCTG

78901  CGCGGGCATG TCGTTGAGCA CGCTCAGCCG GGCCGTCTCC TGCCGGAACG CGCCCTCGTC

78961  CATCAGCCCG GCCCCGGTCA GCGCCGCGAG CACCTGGCTG ATGGGCTCGG GCTCGTGTCC

79021  GGTCAGCCAG GCGAGGTCGG CGGCGGGCAG GGCGGAGCCC ACCACGGCCA GCGCGCGCAC

79081  CACGTCCAGG AAGATCGGCT CATTGCGGTG CAGACAGCTC AGGAAGGACT GGCCGTAGCC
```

-continued

```
79141  GGTCTGGCGG GCCTCCCCGT ACTCACGGTA GTCGGAGAGC AAGGTGTGCA GCAGCAGCCG
79201  GTTGCCACCG GTGGCGGCGA GGATGTCGCC GACGTGGCGG CGCGCGGTCT CCCCCAGCTC
79261  CGCCACGACC ACTTCGGCCA CCTGACCCGG GGAAAGGGGG CCCAGGCCGA TGCGGCGCAG
79321  GTGCTGGGCG CGCAGCAGTT CGTAGCGGAG CGGCAGGGAC GAGGACAGGC TCAGGTCGTC
79381  GGTGAATACG GCCGCGATGC GCGCCGAGTC CAGGCGCCGT ACCAGTTGCA GGAGGAAGGC
79441  TGCGGAGGCC GGGTCGCTGT GCCGGACATC GTCCACGGCG AGGAGCAGTG GTGTGTGTTC
79501  CGCGTGGTCG ATCAGCGAGG TGCACAGCCG GTGGCACAGC CGGGCGATCC CGGCCCGGTC
79561  CACCGGATCG CCGGCCCCGC GGAGGATGTC CGGCAGCCCC GGTACCTCGG GCGGCCCACC
79621  CGGTGACTTC CAGGCGCCGC GGGCCAATTG CGAGACGACG CCGAAGGGAA GGTCCCGCTC
79681  GCTGGGGGAG CATGTCGCGG TGATGGTGAG ATAGCCGGAT TCCGAGGCTC GTTCGGCGAA
79741  CGACCCGAGC AGGGTCGTCT TCCCGCATGC CAGCGGTCCG TCCACGAGAA GAGCCTCCCC
79801  GGGCCGCACC AAAGAGTCAC CGAATGGATG TCCGAGGTGC ACCGCGGTAT TCAATACCCC
79861  GCCCAGCGGA CGGGAATTCC GCTCGGTATT CACCGGCATG GCATAGCTGT AGGGCATGGT
79921  GATGGTCCCC GATCGAGGTC GACGGAATGC GGACTCGCGG CCCTTGAGTC AGACCAAATT
79981  GTTGATCGGG ACACGATTCC ATCAGCACGC CCCTGCCTGC CTCAACCCCT ACCGGAAGCT
80041  CCGCCCCCTA CCGGCCCCA CCACATCTCG TTCTCCGCAT CGGGCTGTTC AGTTATCCGT
80101  GGCGGGCGCC GCACGGTCAA CCCCCTATCG AGTCCGTGCG CCCCTAAAAC GCATGCGGAG
80161  AAAGGTCTCG GTGGCCCGGA CACCGTGAGG CATCACCATG CGGGCGCGCG GGGCATCGCC
80221  GCGAGGGTGG TGCTGACGGT GTCCTCGGGG ATCCCGCGCA CCAGTCCGGG CCCCTCGGGG
80281  CCGTCCAGGA CGAACGTCAG CCCGTCGGTG GCCTTCTTGT CCAGGCGCAT CAGCTCCACC
80341  AGCTCGGACA CCGAGACATC CGGCGGCAGC CCGGTCGGCA GGCCGTAGCC GGATACGACG
80401  TCATGGTGCT CGGCGACCCG TTCCGGGCCG ATGCGCCCCA GCGCGCCGGC GAGCCGGCCG
80461  GCGAAGACCG TGCCGATGGC CACGCCCTCG CCGTGGCGCA GTGCGAACCC GGTGGCGCGT
80521  TCCAGCGCAT GCCCCAAGGT GTGTCCGTAG TTGAGGAGGT GGCGCAGGCC GGAGTCGCGT
80581  TCGTCCGCCG CGACGATGCC CGCCTTGAGC GTCACACTGG CCGAGATCTG GTCGAGCAGC
80641  GGCAGCCCGT CGAGGTCGGG CGCGCCGATG AAGTGGCAGC GGGCGATCTC ACCGAGGCCG
80701  TTGCGCCATT CCCGGTCGGG CAGGGTTTTC AGATGCTCGA GGTCGCAGAG CACGGCCGCG
80761  GGCTGCCAGT AGGCGCCGAC CAGGTTCTTG CCCTCGGGCA GATTCACCGC GGTCTTCCCG
80821  CCGACGCTCG CGTCCACCTG GGCGAGCAGC GAGGTCGGCA CATGAACGAC CGGGGTGCCC
80881  CGGTGGTAGA GGGCGGCGGC CAGGCCCACC GTGTCGGTCG TGGTGCCGCC GCCACAGGAC
80941  ACCACCACAT CCGAGCGGGT GAGTCCGAAT CCGACGAACC GGCGGCACAG GTCCGTCACG
81001  GCGGCCAGGT CCTTGGCCTC CTCCCCGTCG CGGGCGGGCA CGACGAGCGA GGGCACTCCC
81061  GGGTCGGGGG TCTGCCCGGC GGGCCGCGCG GTGACCACCA CCGCCCTGCG CGCGCCCAGG
81121  GCGCCCACCA CCTGTGGCAG CAGCCGCTGC ACACCGTGGC CGATGTGAAC GGTGTAGGAG
81181  CGTTCGGCCA GCCCGACGGT GACCTGCCGG GCAGGGGACG CGGAGCCGGT GGCCGAAGTG
81241  GAAGTCGACG TGGTCAAGAC TGCCTTCCCA TCGCTGACGC GGCCCCGGCG AGAAGCCGTC
81301  TCGCCGGGGC CGGAATCGGG TGCGGAGCCG TTTTCAGTCC TCGACCGCGA TCGCGGCGGC
81361  CGGGCAGAGG AACGACGCCT CGGCGACGCT GTCGCGCAGC TCGAGCGGCG GCCGCGCATC
81421  CAGCAGGACC ACGGTCCCGT CCTCCTCCCG CTGGTCGAAA ACCTCCGGCC CCGCCAGCGC
81481  GCAATGCCCG CCGCGCAGC ACTTGTCCTG ATCCACCGAG ACCTTCACCA TCGTGTTCCC
```

-continued

```
81541  CTCATCATCC TTCTGTCATC CGTTCCGCGG TCACCAGGCG ACGGGCACAC GGGCGACGCC
81601  GAAGTTCATC GACTCGTACA GAAACGCCAG GTCCTCGAGC GGGACCTCCA GGCGCAGCGT
81661  GGGCAGCCGG CGCAGCAGGG TCTCCAGAGC GATCTGGAGC TCGACCCGGG CGAGGGTCTG
81721  CCCCAGGCAC TGGTGCACGC CGAAGCCGAA CGCGACATGC TCGCGGGCGT TGGGCCGGCT
81781  CAGGTCCAGC TCGTGGGCGT CCGCGAAGTG GGGGTCCCGG TTGGCGCTGG GCAGGTTGAT
81841  GATCACCCCT TCACCGGCCG GGATGAGTAC GCCGCCCACC TCGACGTCCT CGACGGCCAC
81901  CCGTCCGGTG CCTTCCTGGA CGATCGTGAT GTACCGGAGC AGTTCGTCCA CCGCGTTGCC
81961  CATCAGCCCG GCATCGGCCC GCAGCCGGGC GAGCTGGTCG GGGTGGTTCA GCAGCAGGAC
82021  GGTGGACAGG GCGATCATGT TGGCGGTGGT CTCGTGCCCG GCCAGCAGCA GCACCAGGGC
82081  GGTGGCGACC ACCTGCTGCT GGGTGAGCCC GCCCGTCGGC TCCTGGTCGA CGATGAGCCG
82141  GCTGAGCAGA TCGTCGCCCG GGTCGGCGCG CTTGGCCGCG CACATCCGGG TCACGTAGTC
82201  CACCATGACG CCGAGCGCGG CGCCCATCTC CTCGGCCGAC GCGGTGAAGT CCATGACGCC
82261  CTGCGACGCC TGCTGGAACT CCGCGAAGTC GGCGTCCGAG ACCCCCAGCA TCACGCCGAT
82321  CACCTGGGAC GGCAGGGGGA AGGCGAAGTC GGCCACCAGG TCGGCCGGCC GGCCCTGGGC
82381  GATCAGCCGG TCCAGGAGGC CGTCGACGAT GCCCTGGATC ATCGGCCGCA TCGCCTCGGT
82441  GCGCCGGATG GTGAAGTTCG CGGTGAGCAT GCGGCGGATC CGGGCGTGCT CCGGATCGTC
82501  CATCCTCCCG AGGTTGAACA CCTCGGCCGG CACCTCGAAC TTCACAAAGC GGGGCATCGC
82561  CTTGTGCGTG CCGTCGGCGC TGAACCTGCT GTCGCCGAGC GCCGCCCGCG CCTCGTGATA
82621  GCCGGTGACG AGAAACGGGG TGCTGCCGTC CCACATCCGC ACCCGCGTGA CGGCGGACCG
82681  CTCGCGCAGT TCCTCGTATC CCGGCGGGGG TGAGAACGGG CATGCAGCAG CCCGCAATTC
82741  GGGGTAGTCG CGTATCTCGT CCATGCCTGT CCGTCCCGTC AGTCGCTTCG TCGCCACCAC
82801  TGCGCCGCCC TACGGATGGA CAAGTCTGGT CCGCGCACCG GATCCCCACT CCCCTAACCA
82861  CTCCCCTATG CCCCCTTGGC TTGGGAGCGG GTATCCCCCC GTGCCCCGGC GGCAGGACGC
82921  TCAGCAGGAG GACGATCCGG TGGCTCCGAT GAGCTGCCAC AGCCGACGCG ACAGCTCCTG
82981  CCGATTTCCG ACCGAGAGCT TTCGGTAGAT GCGGGTCAGA TGCTGCTCCA CGGTGCTGAC
83041  CGTGATGTAG AGGCTCTTGG CGATCTGCCG GTTGGACATC CCCGACGCGG CCAGGGTCGC
83101  CACGCGCCAC TCGGCCTCCG AGAGAACGGG CTGCTCCGCG CCTTCGGCCG AGGCGGCGGG
83161  GTCCGACTCC TCGGGCTCCC CGGTATCCCC GGCGGGTTCC GGCAGTCGCG CGTCCGCGGG
83221  GCTCTCGGCG CCATCCACGA CGAGGTCCCT GCGGCTCTCG TGCTGGGCGC TGATCCCGCA
83281  CTCGTCCATC AGCTTCTGCG CCTCATGCCA GGTGCCGCGG GCCTGCTGGG TTTCCCCGGT
83341  GCTGAGGAAG TCCTGGCTGA GCTCGGCGAG CGTACGGGCG AGTTCGAAAC GGTCGCCGTG
83401  CTCGCGCAGA CACTTGGCGG ACTGATACAG GAGCAGCCTG CGCTTGTCCG GGTCTTCGGC
83461  CATGGCCAGA ACGCGCAGCG CCCGGCCGCG GGTGCTCAAG GGGCGGTCGG GCGACAGCTT
83521  GAGTTCCTCC AGGGCGAGTC TTTTGGCCTC CGCCGGCTCC TGGACACGCA GATACGCCTC
83581  GGCGGCGTCG ATACGCCAGG GCGCCAGGTC GCCGAAGTCC ACGGGCCACT GGTCCATCAG
83641  CATCCCGCTC ACCATGAAGT CGTTCAGCGC TGCGTAGGGG CGGTTGGTGG CCAGGCAGTA
83701  CTGTCCACGG GCCCGGAGGT ACTCCAACCC GACAACGCTG TCGAACATTT CCTTCGGCAC
83761  CCAGTAATGC AGATATCGCT GGGCCTCATC GAGTCTGCCG ATGGCGGTGT GGGCCGCCAC
83821  CAGAACGGAG AGCGGCAATC CGATGGCGAC GCCCCAGCCG CGCGGGGGA TGGACTTCAG
83881  CGCGGTGCCG GCGAGATCGA TGGCCGAGGT GAAGTCCCCA TGGCGGCATC TGATGTAGGC
```

```
                        -continued
83941   GCGCATGGCC AGGGCGACGG CGCCGGGCGT CTTCATGTTC AAGTTGCCGG CCGCGGTGAA

84001   AAGCGCGCCG CACAGCCGGT CCGCCGTTTC CGCTTCGCCT CTCGCGGCCA ATGCCCAGAC

84061   CATCCGGCAG GCGTATGCGT AGGCGAACCA GAAGTGGTTG GAGGGCGACA ACAGATGCAT

84121   GGTGTCGGGA GAGAAGTCCG CCACCTGCCG GGGATCCTGG AAATGCCCGA TCTCCATGCC

84181   CAGTTCGTCG ACGGAGAGCT GAAGACCGTG CTCCAGGTTG GCCGCCCACA GTCCGTCGAC

84241   TTCCCCGGCC GAGGAAGCCT GGTCGGGGAA GTCATGGATC AGGGCCGGTT TGAGGAAGGT

84301   GGCCCACTGC CGGGTCACCC GCAGAGCGGC CATGCTGGAG GCGTTATCGG TGTCACCACC

84361   GCCCGAAAGC CACTTGAAGG CTTCTTCCCC ATCGCTGAAC CGGCCGAACC AGAGCACCAT

84421   GAAGAGCAGG AAGCACAGAT ACTGTTCCGG GATGTCCGCG GGAATTCCT CCCGTATCGC

84481   GGCCATCAGG CGGTCCAGTT CGGGTTCGGC GGTCGCCGGA TTGCTGGACC ATAACGCGCC

84541   GACCAGCGCC ATGAGAATGT CCATGTGCTC GCGCCGGCCG AGGTCCGCGC GGGCGGCGAG

84601   CCGCAGGCCC GCGATCGCTT CCTCCGTACG GCCGTGGTCG AGATTCTTCT GGGCCGCGTG

84661   CCAGAGCACG GTGACGTCTT TTTGGTCGGG CGTTCTGTCG GCGGTGACCA GGAGTTCCGC

84721   CACCGCGATC GGATCGGCCC CGTCGGCATA CAGAAGTTCG GCCGCTTTCG CGCTGAGCCG

84781   GGCCCGGTCC TCCGCCGACA GCGTCTCCAG CGTGATGTAT CGCGCCGCGG GGTGCCGGAA

84841   CCGTCCGTCC TCCAGCAGTC CGGCGGAGTT CATGACGGTG ATGGCCCGGG TCGCGCGTTC

84901   CCGGCCGCAG GCGAGCAGAC TGGCCACCCG CCCCGGGCCG CCGTACCGGT CCAGCACCGC

84961   GAGGGCCTGT GCCACCTGGA GCAACGCCGG ATGGGACAAC AGGCACCCGC GATAGGTCTC

85021   CTGGAACTCC GCGCCGACGG TGACATCCGT CTCCGACCCG CCCGGAGCGG CCTGGAGATG

85081   GTCCCGCAGC AGGGCCTTGA CCAGCCGTGG GTTGCCACCG CTGACGGCGT GGCAGGAGGC

85141   GCGGATCCGG TCGGCCAGGT CGGCGTCGCC GTGCCGCTCC AGCAGGTGTC CGACCCCGGA

85201   TTCCGGGAGT GTATCGATCT TGATCTTGTA GAGCTCATGG AAGCCGTGAG TGCCGACACA

85261   CAACTGATGA CTCTGCCCGC AGGTCATCAC GACGAGCGTA CGGGTGCCGG AGGCATGCCT

85321   GGCGATATGC AGCAGGCACA TGAGGGAGGG GTAGTCGGCA TGCTCGGCAT CGTCAACCGC

85381   GATGATCAGT TGCTTGCCGC CCGCGATGCG GTGCAGCACA TCGGATATCT CTCGGACCAG

85441   GCTTCTCAGT ATGCCGGGTT CGGCTTCCGA ATACCGCTCT CCGGCGGTCC TCCAGCGCGC

85501   CACGACGTCC AATTCATCCG TGAACGCGGA CGACCAGATG AGCTGTTCCA CTATATTGAA

85561   CGGGATCGCG GTGTCGTCCG CGAATCCGGA CGCCATAAGA CAGACCGCAC CCGATTCGGC

85621   CGCCTGCTCC TTCAGACTGC CCAATAAGGA GGTCTTTCCG ACACCGGGTC CCCCGGTCAC

85681   TTTGAGAAGC CCGCCGTTTC CTCGTGCTGC CATGTCGAGG ACGCCGCGAA GCTCTGATTG

85741   ATAATCTGTC AGTCCCATAC TCATCAGTCC TCGCTGTGGG GGTGTGTGCG TdTGAGCGAT

85801   GAGTTGATCT CCGCGGTCAT CCCACCCTGC GGAGGAAGCC TTCTCTGACG AGACAGATAA

85861   CCGCTGCGCC GACGGCGGCT GATTCCCTGA TCTGGATCAC CTCCGGTGGG AGCCCATGTC

85921   CTTGACGTTC ATACAAGCAG AGTCACAACC GGAGCGAAAC CGTCCACCGA TCATGATCAG

85981   CCACGGTTTC CAAACCCCGT GCGAACGTGC CCGACTGAGC GGGCGGCCCC GTCCTCGCAC

86041   CCCCGAGAAG GGCGGGACGC CGCCAGTGCC GGCTTGCAGG ATAAACGCGA TGTGCGGCAT

86101   GCCGACGCGA ATGCACCTCA GCCTCTGAAC CGGTTATGGA CCCGGCAGTA TTCCTTACCC

86161   TGTGCAAAGC TGGTGGCTTA CCAGCAGCCG CCCCGGCCGG TCGCCGCTCC ATGCCCGTCC

86221   CAGCGGGCTC CGGAGTGACA AGTGTCCAAC CTGCGGCCAT CCCCGGTTG CCTCAAAGTC

86281   ATGTCGCATA CCATTCCCGG CAACCTCCTC GCCCCTCAGC AGATAATGCC TGCCCCCGAC
```

```
                                             -continued
86341   TCGTCGCGGA GATACGGGGA TTGACCCCTA CATGCTCACC GCGCCAGCGC GACCATAAAC

86401   GGCCGCCGCC CCATGATTCC CCTAAACTCT GCGCCGTGAT TTGGCCGGGG TTTATCTGCC

86461   TGCAAAACGG CCGAAACGGG TGCGCCATGG ACCGAACCCG GGACCGTCCC CGCGGCATAC

86521   GATGCCGGAA GTCCTGACTG CTGGCCACAT CAGAGACGAG GGAGCGTGAA CTGTGACCGT

86581   CAAGGGCGCG TTGTTCGACT TCTCCGGGAC TCTGTTCCGA ATCGAGTCCA CCGAGTCCTG

86641   GCTCCGTACC GAGCTGTACG ACGCCCTCTA TGACCGCCAC CTGGAGCCCG CGGCCCGGCA

86701   GCCCTACCCG GACGCCGCCG AGGGGCCGGC CGAGCTGCAC CGGCGCGGGG TGCGGATCGC

86761   GGTGGTCAGC GACATCGGCT GATCCCGAAA GGGATCCCGT GGGGCGAACC CACCGGTTCG

86821   GGGCGATCCC CCCGTGTCGC CCGAACCGGC GGAGACATGC GGCGGCCCTG GAAGGATCGG

86881   CGGACAACCG AACGTCGCCT GAGTATATTG GCTGACAGCC AGCCAACGCA GGAGTTACAG

86941   C

AHBA BIOSYNTHETIC GENE CLUSTER DNA
                                                              (SEQ ID NO.3)
    1   TCCCGGGCCG TGTCGGGTGG CAGGGCCCCG CCGTGCTCGG CGCACTCGGT GTGGGGCAGA

61   TCGTCACGTT GTTCTTCACC CGGCCGGTCA GATCCGTGCA GGACGCGCTG GCGGAGGAGA

121   CCATCTACCG GATGATCCTG GAGAGCCGGA GTCTGAAGGT GGCGCTGGCT CGGTTCCACA

181   TCACCACGGC GACCTCGCTC CGGCGGCATG ACGATGTCGA CGGGCAATCC CAGGCACTGG

241   CACGGCAGTT GGAGATCCTG GAGAAGATCG ACACAGCCGA CTTCGAACGG CTCAAACAGC

301   TGGGGGTGAC CCCGCGCGCC GAACCACCGG GGCCCGGCCG GTCCCGCAGA AGGAACCGCG

361   CACAGGCTCC CTGAACACCT CCTACTGCCG AGCGAGGGGG GCTCGCCGTC CCGCTAAGGC

421   CCGGCCGTCA GACCTCGACC ACCGGTGTCT GGAGTTCCGT GACCCACTCC TCGCGGTTCT

481   CCGGACACTC CAGGTTGACC TCCCGGGGGT AGCCGGACGA CCGGTAGCCG TTGCCGTCGA

541   TCCAATGGGC CAGGGCCTGG GCCGTGGGCA CCACGGCGTC CATCGGGCCG CGGTGGACGA

601   TGGTCGCGGC CCGGTCGACG GGCGGCAGAT CGAGGATCCG GAGGTCCTCA CCGTCCCGGA

661   GCGGGGCGGA GACCTGGACG GCGGCGTGGA CGGTGATGGC GCCGCCGCCT TCCGGGCGT

721   CCTCGTAGTA CGCGACACCG GGGCCCGTCG GGGTGATGCC CGCCGCATCG AGGCGCCGGA

781   ACAGCTCGTC GTAGAGGGGT GTGATGACCG GGCCGATGTC CCGGGGGTCG AAGCCGGTGG

841   CGGTCGCGGT GAGCTCCGCC ACCCGCACTG CCCGGATCTC CTTGATGACG ACGTCGTTCG

901   TGGGCATGTG TCCTTCGCTT TCGATCGACC GGAGCCTCGC CTCGACCTGC ACCAGCCGTG

961   CCGCCACGGC GGCCACGGTG GCTTCCAGCT CGGCCCGCCG CAACCGCAGC ATGCCGCGCA

1021   GTTCCTCGGT GCCGGCCTTC TCGTCCACGA TGTCCCGCAC CTGCTGGAGG GTGAAGCCGA

1081   GCTCTTTGAG CGCGATGACC CGGTTCAGGC GGCTGAGCTG GCGGCCGCG TAGTAGCGGT

1141   AGCCGGTGGC GGGGTCGACA TGGGCCGGGC GCAGCAGTCC GGTGGCGTCG TAGTGGCGCA

1201   GCATCCGGAC CGATACGCGG CCGTGCCGGG CGAAGTCTCC GATGGTGAAC ATGATGTCTC

1261   CGAGTCCAGC GCCTCACACG GTGTGAGGGT CAACCCTCGA TTCAGGCACT ACATTCGACA

1321   ATAGAGAATT CCCGGTCATC GCCCATGGAG GGACGGACAG CGCATGACGG CGTCGGCTCA

1381   TCCGCATACC CGCGTCATGG TGGAACTCGG CGACCGTTCC TATCCCGTCG ACATCGGGCC

1441   GGGTGTCCGG CATGCGCTGT CCGGGGTCGT CGCGGGGCTC GGCGCTCAGC GGGTGGCGAT

1501   GGTCTCCGCC CGGCCGGACG GCTGGCTGCC CGACCCGGGC GTGCCCTCGA TGGTGCTGCG

1561   GGCCCGTGAC GGGGAGGCGG ACAAGTCGCT GGCCACGGTG GAGGAGCTGT GCCGGGAGTT
```

```
-continued
1621  CGTCCGTTTC GGGCTGACCC GGTCGGATGC GGTTGTCTCC TGCGGTGGCG GGACCACCAC
1681  CGATGTCGTG GGTCTCGCGG CGGCGCTGTA CCACCGGGGT GTGCCCGTGG TGCATCTGCC
1741  GACCTCGCTG CTGGCCCAGG TGGACGCCAG CGTGGGCGGG AAGACGGCGG TGAATCTCCC
1801  CGAGGGGAAG AATCTGGTGG GTGCTTTCTG GCAGCCGTCC GCCGTGTTGT GCGACACCGA
1861  CTATCTGGAG ACGCTGCCCG CAGCGGAAAT GCTCAATGGA TATGGGGAGA TCGCCCGCTG
1921  CCACTTCATC GGCGCCGGTG ATCTGCGCGG GCTGGCGCTG GCGGAGCAGA TCGCGGCGAG
1981  CGTGGCCCTG AAGGCATCGG TGGTCTCCGC GGATGAGCGG GACTCCGGGC TGCGTCATGT
2041  GCTCAATTAC GGCCACACCT TGGGCCATGC GCTGGAAATC GTGACCGATT TCCGGCTGCG
2101  GCACGGTGAG GGGGTGGCGA TCGGCACGGT TTTCGCCGGC CGTCTGGCGC TGGCCCTGGG
2161  CCGGATCGAC GAGGCGCGGG CGGCGGAGCA TCTGGAGGTG GTGCGGGGTT ACGGGCTGCC
2221  GTTCGCGCTG CCCGCCGATG CCGATCCGGG TCGCCTGATC GAGGTGATGC GGCTGGACAA
2281  GAAGGCGACG GATGGGCTCA CCTTCGTCCT GGACGGTCCC GGCGGTCCCG AGCTGGTCTC
2341  GGGCCTCGCG GAGGAGACGG TCGCCACGAC GCTGGCCGGG ATGGACCGGG CCGGCTCGGA
2401  CAACCGCCGG TAGAACCGGA CGCGGCTCAG TCCGGCAGCC CCTGGCCAG CAGAACGGCG
2461  CCGTGCAGTG AGGACAGCCC GCCCAGTCGC GCGGGCCGGA CCGGTGGCAT CGGATGCCCC
2521  GGGCGCCCCA GCGCCGCCGT CCGCTCGGCC ACCATCGCCA CGAGCTCCGG CATCGCCGCG
2581  GCGAACCCTC CGCCGATCAA CACGAGCGCG GGATGGACCA GTTCGCATAC GCCGGTCACG
2641  GCAGCGGCCA GGGCCCTGCC GCTCTCCCGC AGCGCCGCCA TGGCCCATGG CTTCCCGTCG
2701  GCGACGGCCT GGCGCAGCGC GGCGAAGGTC ACGTCCTCGC CCCGCCGCCG CGCCGCCCGG
2761  CGCAGGGTCG CCGGGCCCGA GGCCGCCGCC TGGACGCAGC CGCGCCGGCC GCAGTCGCAC
2821  AGCGGTCCGT CGCGGTCCAC GACCAGGTGG CCGACTTCGC AGGAGCCGCG GCCCAGGCCG
2881  GGGACGGGTT TTCCGTTCAG CACGATGCCA CCACCGATCC CGGTGCCGAC GCCGAGGTAG
2941  AGCAGATCGG GGCAGCCGGC CTCGTGTGCT TCGGCGAGGG CGGCCAGATC GCCGTCGTCG
3001  GCACAGCGCA CCTCGGCGTC GCCGAAAAGC ACGGACAGCG CGCCACCCAG GTCCACTCCG
3061  GCCCAGCCGG GGCGGCCGGG CCAGGCGGTG ACCGTGCCGG TGGCATCGAG GGTGGCGGGC
3121  ATCGCGACCC CGACGCCGGT GAGCCGCTCG GGGGCGCCGG TGCATAACTC CGTGACGTGA
3181  TGCGCCAGCA GGTCCAGGTC GAGGGTGGGG TCGCCGGACG TCATGGCGTC CGTACCGTCC
3241  AGCTCGGCCC AGCCGAAGGA GGATTCACTG ATGCTCAGGT CGTCGTGTTC GAGGCGCAGC
3301  GCCACTTTGG TGCCGCCGAC GTCGATTCCC AGATGACTGA TGGTCGCCTC CCGGCTCGTC
3361  GGCTTTGGCG GTGTGGAGTG ACGGCGGAGT GGCCGCTCAG TCCGGCACCT TCTCGAGCAG
3421  GGCGCGTGCG GCGAGCCGGT ATCCCAGGGC GCCGAGCCCG AAGATGACGC CCGCGGCCAG
3481  CGGGCCCGTC ACCGACTCAT GGCGGAACTG CTCGCGGGCC CAGACATTCA ACAGATGCAC
3541  CTCTATCCAG GGCCGCGGAT AGTTGGCCAG TGCGTCCCGA AGGCCCCAGC CGGCCATCAT
3601  GAGCGCGGCC GGATTGATGA TGGCGCCGAC CGTGTCGTAG TTCCCCTGAA TGGTGTGGAT
3661  GATCTCCGCT TCGCCGTCGA ACTGGTAGGA ATCCACTTTC CAGCCGCGCT CCGCGACCTC
3721  TTCTCCGACC CAGCGCTCGA TGTCCTGCAG CGTATCCGTG CCGTAGATCT CGGGCTGTCG
3781  CTTCCCGAGT ATTCCGAGAT TCGGTCCGTT CACCAACAAC AGTCTGCTCA ATGCACACCT
3841  CGCCATGTGG GGTCGGCTGA ATTACAGCGG CTCATCACGG AAGTGTATTT ATAGCACGGC
3901  CCTCTTGGCC TCGGCCCGAG AGCTTGGTCA ACTCCGTTTT TAAGGGGGCT GTAGGGGGGC
3961  CCTGAGGGGG AATGACGTTT GCTCCGTCGG CCGGTTAGCG TGCTAATGCG TCCGCCGCGG
```

```
4021  ACCTGCCTCC ATAACGCATT PAGGGAGTAG GGAAATCATG AGCAATGATG TGCGCCTGGG
4081  ATCCGAGCTG CCCGCATGGC CTCAGTATGG CGACGAGGAG CGCGAGGGGC TCATTCGGGC
4141  CCTGGATCAG GGGCAGTGGT GGCGCATCGG GGGCGGTGAG GTCGACGCCT TCGAGGCGGA
4201  GTTCGCCGCG GCCCACGGCA GCGAGCACGC CCTCGCGGTC ACCAACGGAA CGCACGCGCT
4261  GGAACTCGCC CTCGAGGTAC TCGGCATCGG AGCCGGCACC GAGGTGATCG TTCCCGCGTT
4321  CACCTTCATC TCGTCCTCGC AGGCCGCGCA GCGGCTGGGC GCGGTGGCCG TTCCCGTGGA
4381  CGTGGACCCG GACACCTACT GCATCGATCC GTCGGCGGTC GAGGCGGCCA TCGGCCCGAG
4441  GACCCGCGCG ATCATGCCGG TGCACATGGC GGGTCAGATG TGCGACATGG ACGCGCTGGG
4501  CAAGCTGTCC GCCGAdTCGG GGGTGCCGCT GATCCAGGAC GCGGCCCACG CCCACGGAGC
4561  GCAGTGGCGC GGCAAGAAGG TCGGTGAGCT GGGCTCGGTC GCCGCGTTCA GTTTTCAGAA
4621  CGGGAAGCTT ATGACCGCCG GTGAGGGCGG CGCCGTGCTG TTCCCCGACG CCGAGATGTA
4681  CGAGCGGGGC TTCGTCCGGC ACAGCTGCGG ACGTCCGCCC TCCGACCGCG GCTACTTCCA
4741  CCGCACCTCG GGCTCCAACT TCCGGCTGAA CGAGTTCTCC GCCTCGGTGC TGCGCGCCCA
4801  ACTCGGCCGC CTGGAGGACC AGATCACCAC GCGTGAGCAG CGCTGGCCGG TGCTGAGCCG
4861  ACTGCTCGCC GAGATCCCCG GTGTCGTACC GCAGTCGCGC GACGACCGCG GTGACCGCAA
4921  CCCGCACTAC ATGGCGATGT TCCGGGTGCC GGGTCTCACC GAGGAGCGCC GCGCGAAGAT
4981  CGTCGACCTG CTCATCGAGC GCGGGGTGCC CGCGTTCGTC GCCTTCCGCG CGGTCTACCG
5041  TACGGACGCA TTCTGGGAGA TGGCGGCGCC GGACCTGACG GTGGACGAGC TCGCCCGCCG
5101  CTCCCCGCAC TCCGAGGCGC TCACCCGCGA CTGCCTATGG CTGCACCACC GGGTGCTGCT
5161  GGGCAGCGAG GAGCAGATGC ACGAAGTGGC CGCCATCGTC GCCGACGTGC TCGCGAGCTC
5221  ATGAGCGCCC CGCCCGCCGA CGGGACGCCG ATCCGGACCG CCGTGGTGGG GCTGGGGTGG
5281  GCGGCGCGCT CGATCTGGCT GCCCCGGCTC CGCCGCAACC CCGCCTTCAC CGTGATCGCC
5341  GCGGTGGATC CCGACGAGCG CGGCCGCGCG GCCGCCGCCG AGATGGAGGG CGCGGACCGG
5401  CTGCCGGTGC TGGCGGCGGT CCACGACCTC GACCCCGCGG AGGTGGACCT GGCGGTGGTC
5461  GCGGTGCCCA ACCATCTGCA CTGCGATGTC GCCACCGAGC TGCTGGCCAA GGGTATTCCG
5521  GTGTTCCTGG AGAAGCCGGT GTGCCTGACC TCCGAGGAGG CCGAGCGGCT GGCCGCCGCG
5581  GAGCGCTCCG GTGGCGCGGT GCTGCTGGCC GGGAGCQCCG CGCGCTACCG CGCCGATGTG
5641  CGCGGGCTGT ACCGGATCGC CGCCCGGCTG GGCCGTATCC GCCATGTCGA ACTCGCCTGG
5701  GTGCGGGCGC GCGGCGTACC CGACCGGGGC GGCTGGTTCA CCCAGCGGTC GCTCGCGGGC
5761  GGCGGGGCGC TGGTCGACCT GGGCTGGCAT CTGTTCGACA TCGCGGTTCC GCTGCTGGCC
5821  ACCGCCGCGT TCCGGCATGC CATCGGCACC GTGTCGTCCG ACTTCATCAC CCAGCGGTCC
5881  TCGCGGGCCG CGTGGCGGGG CGACGACGAC GGCCCGGTGC TCTCGGGCGG CACCGATGTG
5941  GAGGACACCG CGCGCGGATT CCTCGTCACC GACGACGGCC GTTCGGTCGT GCTGCACGCG
6001  AGTTGGGCCT CGCATGAGGC GCTGGACACC ACGCGGGTCA CGATCGACGG CAGCGCGGGC
6061  AGCGCGACCT TGCACTGCAC CTTCGGATTC AGCCCGAACC GCCTCGAGAA GTCCACCCTG
6121  ACCCGCACCG TCGACGGTAC GACCCGTCCG GTGGCGGTAC CCACCGAACC GATCGGCACC
6181  GAGTACGACC GGCAGCTCGA CATGGTTCCC GCGCAGCTGC GCGACCCGGC GGGGCGGGGC
6241  CGGGTGATCG AGGAGGTCCG ACGGACCATC GGCGCCATCG AACGGGTCTA CACCTCGGCC
6301  CGGATCCCCC AGGAGGTCCG GGAGTCGGTG TCGGCGCCGG TGTGACCGCA CCGGGCGGCT
6361  GTCGCCTCAC CCGCTCGCCT TCGTCATCCC TTGCCGCCCC ATCCCGCTCG TCGTCGTCAT
```

-continued

```
6421  CCCCTGCCGT CTCACCCTGC TCGCCGTCGT CAACCCCTGC CGTCTCACCC TGCTCGGCGT
6481  CGTCAACCCC TTCTCCGGAC CGCCCTGAGA CCCGGACCGG CCCGAGACCC GGACCGGCGG
6541  TCCGCCGAAC CGGCCCGCAC CACGGGAGTC TTCAATGACC AGCCATCCGA TCAGTCACGG
6601  CGCCCCGCTC TCCGGCGCGA GTACCGCCCC GGTCACCTCG GTGGTCTTCG ACCTCGACGG
6661  TGTCCTCGTC AACAGCTTCG CGGTGATGCG CGAGGCGTTC ACGCTCGCCT ACGCCGAGGT
6721  CGTCGGCGAG GGTGAGCCAC CCTTCGAGGA GTACAACCGG CATCTGGGCC GCTACTTCCC
6781  CGACATCATG CGGATCATGG GTCTTCCGCT GGAGATGGAG GCCCCGTTCG TCCGCGAGAG
6841  CTACCGGCTC GCCCACCTGG TGGAGATGTT CGACGGTGTG CCCGAGCTGC TGTCGGAGTT
6901  ACGCCACCGC GGGCTGCGGC TCGCCGTGGC CACCGGGAAG AGCGGACCCC GGGCGCGTTC
6961  GCTGCTCGAC ACGCTGGGCA TCCGTGGCCA GTTCCACGTG GTCCTCGGCT CCGACGAGGT
7021  GGCGCGGCCC AAGCCCGCGC CGGACATCGT GCTGAAGGCG ATGGACCTGA TGGACGCCGA
7081  TCCCGACCGA ACCGTGATGG TCGGGGACGC GGTGACCGAC CTGGCCAGCG CGCGGGGGGC
7141  CGGGATCACC GCCGTGGCGG CGATGTGGGG TGAGACCGAC GAGAAGACGC TGCTCGCGGC
7201  GGAGCCCGAT GTGATCCTGC ACAAACCCGC CGAACTGCTG GCGCTCTGCC CCGAGGTGAC
7261  GGCTCCGTAG CTCCGCGCGC CACGTCCGTG CAGGTACCTC CACCGGGGCT TTCGCCGCCG
7321  TGTCACACGC CGTGGTGGCT CACCCGGCCC GCGCCTGCCG CCGGTGCGCC CGGCCGGCGT
7381  TCGCCTCCCC GCCGTCTCCC GGCGGTGTGG CCGGTCACTG ATCAAGACGC GCACCCCCGT
7441  ACGTCACCGG CCGGGCGGGG GGTGACGGTG GTGACGTACG GGACACGACG GGCGGTCGCT
7501  GATTGGCCCG CCACCCGCCG TGTCCCGCAT CATCGTTGGG CTCAGCCCGC CAGCCGCACG
7561  GGTTCTGCGG CCTTCTCGGC CGCGGCCAGC AGTGCGGTGA TCTCCTCACG GGCGCGGGCC
7621  ACACGGGAGC GCACGGTGCC GATGGGCAG CCGGTCGCGG TGGCGGCGTC CGCGTACGGC
7681  AGGCCGAGTA CCGTGGTGAG GAGGAACATC TCGCGGCGCG CCGGGGCGAG CCCAGCCAGC
7741  AGGTCCATCA GCGCCACCCC CTCGTCGAAC CCGGGGAGCC CGACGGGCTG CGCCCGTTCG
7801  GCCACCTCCT GCCAGTCGTC CGACTCCAGG GTGCGGGGGC GGGCGGCGGT CATGCGGTAG
7861  CGGTCGACGA CCACCCGGCG GGCGATCGAC AGCAGCCAGG TGCGGGCCGA TGAGCGGCCG
7921  GCGAAGCGCG AGAGTCCGGT CAGCGCCCGC AGATACGTCT CCTGGGCGAG GTCCTCACAG
7981  CCGTGGGGGT CGGCGCTGAG ATGGAGTACG AAGCGGCGCA CATCGCGGTA GGTGGCGCGG
8041  ATGAAGTGGT CGACCGCGTC GCGGTCGCCG TCACGGGCGG CCAGCGCCCA TGCGGTGACC
8101  TGGCGGTCGT TCGCCGCGGT GGTGAAGCCG TGCATGGCTC TCATCGGTGC GGCGGGCAGC
8161  GTGGCGGAAG GCATCGTCAC ACGTCCTTCG GGTGGCGGTG AACGGCACAC CGGCATGCGC
8221  CACCGGCCGC GCGCGGGCGC GGCGGGGCGG CGAGGAGCCG GCGGTGCCGA CGGATGGGGC
8281  CGACGCCGGG CACGCGCCGG TACTCCGCCC GTCAACCGGC ACTCACCCCA GGTCGGGGCG
8341  GGGGAAGGAC GGGCGGTTCA GCGGACGGCG AACCGCCTCG GTGGCCCTCT GCGGAGAATG
8401  GCGTGCCGTA GCAGAACTCC GCGCGGCCGG CGGGCGAAGG CCGGTGCGGA CGGCCATGCG
8461  GGCAGCGGAG TGGCGCCCGC GCCGAGGATG CGCAGGGCGA GGACGAGCGG ACGAACAGC
8521  AGGGCCGCGA GCGCGCGGCC GAGGCGGAAG GCCGCGCGTT CGCCGCGCCA CAGCCACAGT
8581  CCGCAGACCA GCGCGGCGAG CAGGTGGGCC GCGGCCATGC CCGCCCCGCC GGGGCCCGCC
8641  CAGGGCCACG GCAGATGGCC CATCGACGGC GCGGCGGAGG ACATCGCGTC CGCGCCATGG
8701  TGCATGTGGC CCATGGCGCC GCCGCTCATC CGGGCGGTGC CCATGTCCCG CATACCGGGC
8761  ATCCGGTGGC CCATGCCGCT TCCCGCGGCG GGAGCGACGG TCATCTCCGC GAATCGGAAC
```

-continued

```
8821  GCCATGTGCA GGCCGAGTTG CGCGACCACC GTCGCACCGG TCACGACCAG CGCTCCGCGC
8881  TCGCGCCCGG CGACCCACCA CGCGGCGGCC GTCGTCGCGG CGAACGCGGC GGCCACGGCC
8941  CACACCGGCA GGGCGTCGCT GGACATCAGC GTGTGCCCGA GCGCGGTCAC CACGACGCAC
9001  ACCGCCGCGA ACACGGCGGC TCGTGCGAGA CGGAAGGGTG GCCCGGCGGA CATGGCAGCC
9061  ATGGTGCCAG CCGTCGCCGG TGCGCGTGAC GACGGCTCAA TCTTCATCAC GCCGGTGACA
9121  AGCGTGGCGT GTGGGCCGCC CCCGAATGTG CTCATGTGAG CCAGTTCACA GATGATGCCC
9181  GGAACTCAGC CGTGTGTGCG GCCGACAACT CAACCGGCGG CCCGATATGC GTCCGCCTCC
9241  CGCCGTTGCC CCGAGCCAGG AGTCGTCCAT GTCCGCTGAA CCGCTCGCCC GGCCACGGG
9301  CGATTCCCCG GATGATGTCG CCGACAGGGA GCCACGCTCC CTCGCCGAGG CCGAGTCCGG
9361  CGGGTCCGGG TCCGGCGGGT CCGTATGGGC GGGCCTGCGG CCGCTGGTGC TGCGGCTGCA
9421  CTTCTACGCG GGGGTGCTGG TCGCGCCGTT CCTGCTGGTC GCGGCGGTGA CCGGACTGCT
9481  GTACGCCGGA TCGTTCCAGG CCGAGAAGCT GGTCTACGCC CACGAGTTGC GCGTCCCCGT
9541  CGGCGACCGT GAACTGCCGA TCTCCGCACA GGTGGCAGCC GCGCGCAAGG GCCATCCCGA
9601  GGGTGAGATC AGCGCCGTAC GGCCCTCCCC CGAGGACGGC GCCACCACCC GGGTGCTGCT
9661  CTCCGGCGTC AAGGGCGTCG ATCCCGACCA CACATTGGCC GTGTTCGTCG ACCCGTACAC
9721  CGGGAAGGTG CGCGGGGCGC TGGAGCAGTA CGGCTCCACC GGCGCCCTCC CGCTGCGCAC
9781  CTGGATCGAT GAGTTCCACC GCGATCTGCA CCTCGGGCAG ACCGGCCGCC TCTACAGCGA
9841  ACTCGCCGCC AGCTGGCTGT GGGTCATCGC CCTCGGCGGT GTGGTGCTCT GGCTCAGCCG
9901  TCGCCGTAAG AAGCGCACGC TGCGGGCGGT CGCGCTGCCC GACCGCGCCG CCACCGGCCG
9961  CAAGCGCACC ATGTCCTTCC ATGGCGCGGT GGGGCTGTGG GTGGCGCTCG GGCTGCTGTT
10021 CCTGTCCGCC ACCGGCCTGA CCTGGTCCAC CTACGCGGGG GCCAACGTGG AGGACCTGCG
10081 CACCGCCCTC GGCCAGACCA CCCCGACCGT GTCGGCCACG GTCGGCGGCG GTGAACACGC
10141 CGGACACCAC ATGGGTTCCG GTTCCATGCC GGGCATGGAC ATGGGCCGTA CGGGCGAGGC
10201 GGCCGGGCAC ACCGCCGATG CGGGCCTGGA CACCGTGCTG GCGGCCGCCC GCGCCAAGGA
10261 CCTGGACAAC CCCGTCGAGA TCGTCCCGCC CGCCGAGCCG GGCAGTGCGT ATGTCGTCAG
10321 CCAGATCCAG CGGAGCTGGC CCGAGAAGCA GGACTCGGTG GCCGTCGACC CGGCCACGGG
10381 CGAGGTGACC GACGTCCAGC GGTTCGCCGA CTACCCGGTG CTCGCCAAGC TCACCCGCTG
10441 GGGCATCGAC CTCCACACCG GAAACCTCTT CGGCCTCGTC AATCAGATCC CCTGGCCGC
10501 TCTCGCGCTC GCGCTGATCC TTCTGATCGT CTGGGGCTAT CGCATGTGGT GGCAGCGCGG
10561 TCGCGCCTCC GCCTTCGGCC GCCCGATCCC CCGCGGCGCG TGGCGGCGGG TACCGCTGTA
10621 CGTCCTCGTC CCCCTGGCCG CGGCCACCGC CGTGATCGGC TACTACCTGC CCCTCCTCGG
10681 TATCCCGCTC GCGACCTTCC TGGCCGTCGA CATCGTCGCG GGCGAGATCG CCCGCCGGCG
10741 CCGCGCCGCC CCCGCCGCCT GACCATCGCT TGCCATCTC GGCAACAAGC TTTGCGCTCA
10801 C
```

Although the present invention has been described in detail with reference to specific embodiments, those of skill in the art will recognize that modifications and improvements are within the scope and spirit of the invention, as set forth in the claims which follow. All publications and patent documents cited herein are incorporated herein by reference as if each such publication or document was specifically and individually indicated to be incorporated herein by reference. Citation of publications and patent documents is not intended as an admission that any such document is pertinent prior art, nor does it constitute any admission as to the contents or date of the same. The invention having now been described by way of written description and example, those of skill in the art will recognize that the invention can be practiced in a variety of embodiments and that the foregoing description and examples are for purposes of illustration and not limitation of the following claims.

SEQUENCE LISTING (153 sequences)

SEQ ID NO: 1 - DNA, 85692 bp, Streptomyces hygroscopicus
agtctaggtcggactagaccttgtaaaacgacggccagtccagtgtgctggaaaggcaacgcgtcgtccggggccaggacttcgatcacccggtccgccacccgcccgcgcacgcccttgcccggcagtgcgacgaagtcggccacggccgggagggggtctgcgggatcggtgcgccgggcgtaggcggtgatggcacgccccagcgggtgttccgatccctgttcgaccgcgcccgccagccggaccagttcctcctcgccgagtccgcccggtgcagccgtgacccgggcgacgctcatgtgcccggaggtgagggtgccggtcttgtccaggacgacggcgtcgatgtgccgcagcccctccagcgcctgcggtccgctgaccaggacgcccagttgggcgccccggccggtcgccgccatcagcgcggtgggggtcgccaggcccagcgcgcaggggcacgccacgaccaggacggccacgctcgcggtgatcgccgcctgcggctcggcaccggccccgagccagaatccgaggaccgtgacggccagggtgagcacgaccgggacgaagacgcccgcggccttgtccgcgagccgctgcgcccgtgccttgcccgcctgggcctcggtcaccagccgggtgatccgggacagttgcgtatcggcgcccaccgcggtggcccgtaccaggagcaggccccctgcgttgacggcgccgccgatcacgggcgtaccggggccgacttccaccggctcgctctccccggtgaccagggagagatcgacggccgagctgccctccaccaccgtgccgtcggtggccagacgctccccgggccgggcgacgaagacctggccgacccgcagttcctcgatcgggaccaggcgctcgccgtcgccatcgcgtaccgacacctccttcgccgccagccgggccagggcgcgcagtgccacgccggtcccccgccgggcccgtgtttccaggaagcggccggcgaggacgaacagcggtacgccgacggcggcttccagatagatatgggcgacgccgtccgaggcggtgggcaccaggctgaagggcatccgcatgccgggatcaccggccccgccgaagaacagcgcgtaggaggaccaggcgaaggaggccgcgacacccagcgagaccagggtgtccatggtggccgccgagtgtcgcaggccgcgcgccgcccgcaggtggaagggccaggctccccagacggcgacgggcgcggcgagcacgaagcacagccactgccagttgcggaactgcagaccggggaccatcgacaggaccagcaccgggaccgcgagcaaggccgtgctcagcagccggtcgcgttcctgccgggcgtcccgcgcctcgtccccgtcctcgcgccgttccttcgccggcggctcgggcagcgcggcggtgtagccggcctgctcgacggtggcgatgagctggtccgggccgacctcgggcgggtggttcacccgggcccggccggtggcgaggttcacgctggccgtgaccccgtccagcctggccagcttcttctcgacacgcttcacacaggccgcgcatgtcatgccgccgatggcgagatcggtcacgacggccaccgctgccggttcgccggccatcagcgtccactcccctggtccgtgtccatgccacccatgtccatgccgccaccgccgtggccgtctcccgagccgccgtctcccgagccgccgtctgtcgtgctggtgccgtgcatgccgggggcgacgggcccggcgcccgcgccgacggcgtaggaagcggcgaacgccatcaccagcagcagaaggaatccgcacagcgccggcgggggcaatgccctggtaaggaacgcacccggcgtccggcgggcagatgggcggggctgcgccatatgaggaaactcccgatcgctccgtacggcttcagcggatccggccgtaccggtagaggagtcgggacggccggcacccgagttccgacgccttgtcgtgacgcgcgtcacgacaccaggctcgcctgccgaacgcgtgacctgctcagccctgttcatagtggctcggactgccgtcacggtggacgagacggccaagctgctccgcgcgggcgcggggcatgagagtccaggtgccgtcggtgcggtgcagggcggccgagtgccagggggtggcccagacgtcggcggcgtcgaggaggcggatgccgaatttgggggcgccgatgggctgggggtggatggacagccgtacggagccagggtggtgctcggcgatcaggtcgccccaggctcggctgcgctggatgacgccgtaggcgcgtgtgcggcattcgcgttggagggcggagcgggtgccggtgaagtcggcggtgtcgtcgacgaggaaccggatgatgccccggtagagggcgagggtgtggtccccggagcggacctcggctcgcagcgcctccagggtgggggcgtaccgctcgtgcacctggacgcgtttggtgtggtggggcaggtcgcccaggacgtcgcgcaggtcgaagacggagaggcggtgcaggcccgactcccttatgagacgtctgagtccgtccgcgtaggcgtctatgtggtcgtccgggacgcggatcaggtcgccgaagacatggccgtcggagcagatgatcacgcgggcgcccggcgggtggacccgctcgatctcctcgcacagggtgttcaggaagccgagggagaggcgttcgccctggtcggggaggtggccgaggaccttggcggggttgggggacttgcaggggaagccgggcagggtgaagaccacaggttctccggcgcgtacgaacccggcgatctggcgccgctgctgcgcgaacgcctccgccgccgcgggcgaggggtcggtcgtgcggtggtacggcagcagcaggtccaggatggcggcgctcatgctgctcgtggagcgggtgtccggtgcggtcgtcagcggcatgaggtgggttcctccgtgaaggtgtgcgcgacgcgggcatgcgggcatgcgtcagacgcgtcggtcgtagccgaccggcaggtggttggtcccccggccgaggacggccgggatccactcgatgtcccggtcttcgatggccaggtgcgctccggggaggcgggacaggagggtgcccagcgcgatctggagttcggcgcgggccagggccgcgccggggcagaagtggatgccgtgaccgaaggccaggtgggggttgggtgagcggtccaggtcgagggtgtcggggtcggggaagcggcgtgggtcgcggttggcggcgcacagggagatgatcaccgagtccccggccgggacgtccgtgccgtgcaggtcgctgtcctggtcgaagaagcgccaggtggtcagctcgaaggcgctgtcgtagcggaggagttcgtcgaccgcgcggggcatcagctccgggtcgtcgcgcagccgggcgagttcggcggggtggcggaagagggcgatcagggcggtggtgatctggttggtgaccggttcctggcccgccacgaggagctggaagatcatcgagtccagctcctcctgggagagttcgctgcggtcgcgggccacgaccaggcggctgagcaggtcgtcctccccgtgttcgcgcttatgggcgacgacctcggctatgtagctctggagcccgtgcaggcgggcctcgtacagcgggcgtccggggtcggtcggtccgaccggctggacgaccttgccccagtcgcggtcgaagcgggccgccgactccggtggcaggccgatgacttcggcgaggacctgcaaggggaagcgggcggcgaagccggtgaccaggtccgcggggccggtttccgggagggcgtcgacgagggtgtcggccagctcctggaagcggggcctcagatgctcgacgcggcgcggggtgaaggcgtcggtgacgaggcgccgcatgcgggtgtggtccggcgggtcctggtggaggaggtggacctggagctgggagtgctggggctcgggcatgatcgaggcgcgggcgcgccagcggtcgttgccccggtcgtggttcttgccgaggcggtcgtcgcccagcgcggagtgcgcggcgtcgtagccggtgacgagccaggcgtggacgccgctgggaaagcggacgcggtgcaccgggccggtctcgcgcatccgctcgtagagggggtacgggttgctcttgtaggggcagcccatcagcggcacgggctcgggcagggcctcgggggtcgtcccggattcctggagggtcatggaaggtgctcctcagagggcgagttcgggctggtagtggtccagccacagggcgaggtcgacgacgcgttcgaggcggaggcggtggccccactccagttgaccgggcggggtgtcgaggcagggtttgacgcgggtctcgtcggcgagggagcggacggtgtcgtcggcgagggcgtcgcgggccatgttctgcaggccgcggttgtagtcggggtgatgggtggccgggtagtggttcttggggcggtgcagcaccgagtcgggggccagtccggtacccgcggcgcgcagcaggctcttctcccggccgtcgaagttcttcagggtccagggcgtggtgaaggcgtactcgacgagccggtgatcgcagtaggggacgcggacctccaggccctgcgccatgctcaaccggtccttgcggtggaggagttgacgcagccagcgggtgagcgaaaggtgctgcatctcgcgctgccggtgctcggtgggcgtctcgccgtcgaggtgcggtacggcggccagggcggtgcgataggtgtcggcacggaactcgccgatgcgcaggtccagttcggggttgagcggcatcgcggcctcgtcgccggtcaccagcagccaggggaacgtggacgcggcgagcgccttggggttgtggaaccacgggtagccgccgaagacctcgtcggccgcctcgccggacagggcgaccgtggagtgcttccggatctccccgaagaggaggtagagcgaggtgtccatgtcgccgacgccgatcggcgagtcgcgggccacgaccacggccttgcggtgctcggggtcgagcagggcacgcgggtccagcaccaccgtgctgtggtcggtgccgatgaacgcgcccgcttccgtggcgtacggggtgtcgtggccggtgcgcagaacatcatcggtgaagctctcggcctggtcgctgtagtcgacggcgtaggagcggatacgggcgcccgggccctcgcgcagccgcagttcgtcggcgagcagggcggtcaggacggtggagtcgatgccgcccgacagcagggagcacagggggacgtcggcctccagctgagcgcgggcggcggcgctcaccaggtcgtgcacgcgggcgacggtcgcgtcccggtcgtccgggtgggcgtcggccgccagccgccagtagcggcgctcgcggatgccgtcccggtccaggaggagcagaccgccgggctcgacctcccgcacgccggaccacaccgtcggaccggtgttgaacagcaggccgtacgcctcgcgcagcccgtccgcggccacccggggccgtatctccgggtgggcgaagagcgccttgggttcggaggcgaaggccagaccgccgtccacggccgcccagaagaggggcttgacgccgagcctgtcgcggaccaggagcagccgctgtgcccgctcgtcccagacggcgaacgcgaacatgccgtccaggtggtcggccacctcctcgccccactcggcgtagccgcgcagcaccacctcggtgtcgctgcgggtgcggaactcatgtccccggcccttcagttgtgagcggagttcgtggtggttgtagatctcgccgctgtaggtgagcacggtcgtcggggcatcgggccggtcggtcatcggctggacgccaccggcgatatcgatgacggccaggcggcggtggccgatcgcggcacgcgggccgagccagactccgtccgcgtcggggccgcgcggggtcagggtggcggtcatggcctcgatgaccggggcctgggtgcgggggtcctgatggaaggacacccagccggtgattccgcacatgggcacgactcctcggtgagggtggggcggtggctcagcggggtgcggcgggcgccgcgtcggtggtcttctcggtgaggttcgcgggatcgcgggcgggccgggcgagcagcggtacggcgaggcaggcggcgagggcggcgagggccagacccgcccgtacgccgtcgtcctggccggccggcccccaggccgccgtggccagggccggtccgagcgtgaagccgaggctgcgggcgagctggacggtcgagccgaccgtggcggcgcggcccggcggggcggcgcccatgaccagggcctgcaccgggccgccgttcaggcccatgccgagtccggccagggcgagccgccaggccacgtcgggaggggaccagccgtcgcccagcgggacgagcagcaacaggccgccggcggtgagcgcggcgccggtgaccgcgacgggccgggccccgtaccggtcggcgagccgtccgccgagcgggcccgccagccccatgccgagggggaaggcgagcaccgtcaggccggtggtggtggcgctgacgtcctcgtcgcgctggaggtgcagggcgaccacgtagtgcatggcggcgaaacccaccgccagcgccagcaccgcgccgtgcgcccgcagcagccccgccgcccgcagcacaccggccaccggacggccgcccggaccccgcagccaccaccacagcggcggtgcggcgacgagggcgagcggcagccaggcgggtgtgtcggaggccagggtcagggacagcagcaggatcgttactccggtggctatcagggcggtgtcgccgaggaagcgccggtccgcgccgcgcaggcggccgtcccggggcatcgcccgccacaccacggccagcgccagcagacagaacgggatcttgaccaggaagatccagcgccagccgagctggtccaggagcagaccgccgaccgccggtccggtgacggcgcccagggggccgagggtcgcgggcacgctcatcgcccgcccgcgcgactcgggccgcaccgagcggatcgccagcaccggcatcgacacgaacagcaccgcaccgcacgcgccctgcccgatccgggcggcgatcagccaggcggcccagggggacgcggcggcaagcgcgctgcacagcgcgaagccaccggtggcggccatcagcgcggggcgggtgcccacgccgtcgagccagcggccgacgggcaacaggagtgcgacgacgggaagttggtagcccagtaccgcccactgggctgtcgccgccggtacccgcaggccctgggagatgtccgcgagcgccacgttgacgatattcatgtcgagcatcgccacgaacgccagcgcgcccgccacggccaccaggagccagcggtcgtggacttcgggtggatccgccggacgctcggttacgtccccgggctgatccgcaccggaagcgtcgtcggtcatacgcccctccctctggccggtcggccgccgagcgacggcctcgctgtagaagtcgggcgaaccgcggagtgagttcccggatgtatcaggaaaaacggctggatttcatagttctcggtggtcgaaggcgatcagcgggtccccggtcagcgggtgctcgaccacggcggcgcgcacgccgaacacctcggccagcagggccggtcgcagcacctcgcggggcgttccggaggcgaccacgcggccctcgtgcaggacatgcagccggtcgcacacggaggcggcggcgttgaggtcatgcagcgacaccagggtcgtacggcgtcggccgcgcagcagggcgaggagttcgacctggtggcggacgtcgaggtggttcgtcggctcgtccaggaccaggacgtccgtccgctgggcgaacgcacgggccagcagcacgcgttggcgctcaccgccggacagctcggtgaagtggcggtcggcgtggtcccccatgccgacgtccgcgagagagcgctcgacgatgtcccggtcggcggcgtcctccccggcgaacgcccgcttgtagggcgtgcggcccatggcgacgacctcacgtacggtcagctcgaagtccccgccccgctcctgcgggagcgcggcgacgtgccgggccgaccgcgcggggctcagctcgcggatgtcggtgccgtcgagcaggacacgtccggcggcgggcttcagatgccggtacacggtccgcagaagagtggacttgccactgccgttgggccccaccaggccggtgatctcgccttcggccgcgatgaggtgggcatcggccacgaccgtacgtccggcatacgcgacccgcaggtcctcgatgtcgatcctcaactcccgctccccaagcgccggtccagcagatacagcagcgccggagcgccgatcagcgaggtgacgaccccgaccggcagttcctgcgtgtccatggccgtgcggcacacgatgtcgaccaccaccagcagcagcgcgccgaagagcgccgacacgggcaacagccgacggtggtcgccgccgacgaccagacggcagacgtgggggaccatgagggcgacgaaggcgatggccccggagaccgcgacgaggacaccggtgagcaggctggtgaccgcgaacagctcacggcgcagccgtacgacgtcgatgccgagcccggccgccgtctcgtcgcccatcagcagcgcgttcaggccccgggcccgggcctggagcagcagcaggaccgccggaaccgccaccgccggggcggccagcagcgcccagctcgcgccgctcaggctgcccatcagccagaacagcacactgtgggtctgctgctcgtccccggcctggaggacgaggtagctggtgaagccggacaggaactgcccgatggccaccccggcgagcaccagcctgagcggtgcgaatcccccgccacgtcgtgccaccgcccagacgagagcgaaggtggccagggctcccgcgaaagcggcaccggacaggccgaggcccagcgctcccccggcgccgaggccgaggacgatggcggcgacggcaccgagggaggcgccgttggagacgcccaggaagtacgggtcggccagcgggttgcggacgagggcctgcatggccgtaccgaccaggccgagcccggcacccaccagagcggccaacagggcgcggggcaggcgtagttgccacacgatcaggtcattggtgccgggccggggggcatcgccggtcagtctgcgccagaccacgctccacacctcgcccggcgggatcgacgtggaaccccaggcgaccgccgctgtgagggccgcgagcaacgcgaccgccaggagcagcgccagcggcccggcgggcacggaacgccgcgtgcgtgcacgggcatcggtgcccttcccgctcaccgtggcgtcgagcgccatcagccgaccttgcccgggtagagggccttggcgatctcctggacggcgtcggcgttctcgactccggcgatggtgatccgctcggagccgatgcgcaggaagtggccctcctcgactgccttcaggcccttggtggcggggttcgactccagccacttccgcgcctcgtcgaacgccttctcgttcgccacctcgctgccccgatcacggacgcccaactggatccagtccgggttcctggaaatgacgtcctcccagccgacctgcttgtagtcgccgtcgcagtcggcgaagacattgcgggcaccggccagagtgatcaccgcgttggcgacctggcggttgcagacgacggtgggctgcttggtgccggcgtcgtagtcgaagaagaagtacgtcggccgctcgccctccgccgtccggccgacggccttgtggacggcgtccaccttccccttcattccgtcgacgagttccttcgccttcgcgctggtgccggtgaccgcgccgagggaggtgatgtcggcctccaccgcggacaggtcggtcaccgcgcgtgtgttccgcgccgcacaggcggtggacttgaggtagatgtgcttgatcccggccgccttgaactcctcctcggtcggcgcgtcgcccatgccgccgcccatgttcatcgaggcgaaggtgtcgatgtacagatccgcgccggagccgaggagcttctccttcgggatcaccgattggccgagcaccttcaccttccgcgcctgcgcgtcgagttcagcgggcagtgagcccttgccgggcgggaagccggtgccgatgacgttgtcaccggcgccgaggcggagcagcagctccaggctggaggcgttactggtgacgatcttcttgggggcgttggagaatatggttttggcgcccatgcaatcggtgacggtgaccgggtagtcgccggtggccgacttctcgtcagcggggcccgctttgtcaccgtcgccactgccgcctccgtcgccgcagcccgccacgaggaggccgcccagcacggcggccgtcgtaccccaccacacacgagaacgcatcgaaactctcctggatccacttgatacacgggttgccccggatcagtagtcgtggcggatgcggcatcggttcccgctcgtcgggagccggcgagagccatggtcaccgcgccggcccctcggctcggccgggggtacaaccagaccagtaagcgcgtacaggcagactacgtacatggcgtcggtgacgcccggctgatcgggagcggcagttgatggagtcgacaggagagatcgtgcaccgcaattttcgcctggctctggggcggctggcagccctcgtctgcgcgtctgtcgtcgccgtcacgggctgtggcggcgacgacgaatccgaggctccgaagccgacctcgaagccgaccgccaactccgggctcgtacctgtcgcccaggcctgcgatggcctgttcgacgaggccatcgcgaaggaggcccgggggccgaacgggcccggcaaggtctatccggtcaagaccgggagcacctctcacgtggcgaaggcgctgcgggaggagtcggccaggagaagcacgcccgaggacctctgcaccttgacggaccaggctgaggggaaggagctgctcgccatcaccgtggcgtggactccccactcacccccgtcgggccagtcggcgcgctacacgaccaccgtcggtccggaagacgccggcaggctcctcgtcacatgtgacatcggcagcggcggcgggacggaatcgggaggcgggacggaatcgggaggcgatcgttccctggagttcgccatgcgcgactacttcaccgtcagcgaccactcccacgccaagctgctcatcgcctcggcgaagaagataacgtcgcagttgaagtgccgggaaactcccgaatacccggatccgaaggttgtggcaccgccaccgaagcgggggctgcggtagcgcggtcctttcaccttgcggcaggtgatggcggtttaatcgagtcatgatctaccacgtcgtaccgcttgccgagtggaacgctgctcccgaccacccctacagccccgcatccctcacggaggacggtttcatccactgctctcccgacgaggagaccacgctggccgtcgtcaacgccttctaccgcgatgcgccgaggccactgctggcgctgctcctcgacgaggaccggctcaccgcgagatgtgaatgggaggccgctgaccccgccccgccgcccggcgtcgccgagaacagtctgtttccccatgtcttcgggccgctcaaccgcgacgcggtggcgcggatccaggaggtcgcatgggactcggaaggccgggcggtggggctgacggaggtgagctgacgacgagggccgtcacagtggcgcgaggcgggccttgagcaggcagaactcgttgccttcgggatcggcgaggacgtgccactgctcctccccggtctggccgatgtcggccgggcgcgcaccgagcttcaggaggcgttcgagctcggcgtcctgatcgcggtcggtggcgttgacgtcgatgtgcagccggggtttcccgggctccggctcgtctctgcggctgaggatgatcgtcggctgcggaccgccgaacccttcacgcggcccgatctcgagggttccgtcgtcctcgcgatcgagcaccacgaagtccaggacctcgcaccagaaccgcgccagcacctcggggtcgcggcaaccgagcacgagttcactgatacgacatgccattgacgaaacctactctcggcgtgggaactgccgggggtggccgcacgcagatctcaggggctccccgcagtgaggactctcgggaccgtaccgggccaggcgagcagtggcgaatggatttcacgccctcgcctgcctgtgcgtcgtggacggccgagtacggccaccgcggagacacgcagccaaccccagcgcgcagatcggactcgccctgcccctgaccgactcgttcatcgccttgagcgggcccctgtgcggacaggacttcgtggcggcggccgcacagcgcagaagctgggcctgctcggctccgacgtcggcggcatccgtgccgcgttcatcgacggcgtggtgtagacgtgcgccacacgccgtaatcggccgcggtggatcccgggtgtggtggtggtaccggtgacgtgaccgagcctgcccgccgaccggtcgccggaccaccactccaaggcaactcgccacccagtcggccctgctggaacgcggtccgctcctcgatcagctcgcggacagcgccaccaggctgacctcaccggagtcccctgcgtcggcctggatcggcctcgccctttgcttcgcgggcgccctgctcacgccgtgctccagccggtggtccggatcggatgtcctggaatgcgagagggcccccggatggttccgcgggccctcgtgcgcctaggcatcgtcagtgcgtggcggtcgccaccgcccggccctcatcggccgtcgcgggcttggggttcagcaaccgctcggcaagctcaccgaacaggagaccgaaaccaccccacaggacgacctgcatggccagagcggacaaccggaaccgccacaacacggtggcggggaagtcccccggcacctcgttgaccacgggaaggaaggcatacgccagcccgaccaccacggcgaacgcggccaccgcggccacggtcgcgtaccaggtgcccagcctcggggcgagccgcttgcccacaatggtgacgcccaccgcgaggagcacactgagcagcatcatcaggaaatacagcgtcgtgcgcttgccgatcgtgtcgccgttgccgaccgcgggcggattggccgggtacttcaggaacggcaccacgtagaccgccagcagcgcgcagccggacagcagcagcgcggtggcccgcggggtgaagcggccgacgcggcccagggcgacgcagtacgcgagggcggcgataccgccgaaggcgatcccgtagaccaggacaccggtggccagcccggccgtggactgcacaccacgcgagaccagctcgacctcgtgctcatgcgcgggagcgtgggccccctcgaaaccgatcgcgcggtcgacgctcggctcaccgaggaagtaggcggcgaccagggcgagcacgccggcccccagaccggcgagcatgccccggacgagcagatttcttaccattgcggagttcatgagtgtgcggcgtccctcgcgtcagtggcaggggaaaccgagcagatgacgggcgtcatgcacccactcatggacgttctcaccggagacgaccgcggtggcgccctgctcggcgccgacgaaatacagcaggaccagcatcagaatgccgaagaaaaccgcccacggagctatcgccttcagcggcagcgtggcaggcagttcgggcgtggtggctgtgggctgcgcgacatgctgcgccatggccaggcctccttaagggagttcgcgtcccatctcggtggagcacaggacgacggctacgggtctgactcacgagagaccccgtccgggacctctcgctcacagtggcgcgaccgtgccggattcccaccggcttccgtcttaccgtcgtcgatatcgcaccgaccgtaccgcgtgtcgggttcatggccaagaccagccacctggcgagacgctgcgctggggtgcctgaggacggtgcgggagccggggcctgcccccgggcaggccctaaagtcgcggcatgcgtccgtccgccgaaaagcggcaggcccgcacggcggacgcccccgccgctgcgttgaccggcgcatgagcgggtgctcgagacttcttgcctacgatgtgctgatgcaggtgatgcgcaccggtcttggctccctcccggacgacaccccgtgacggacctgatccgccgagccctgaccggccgagccgcccggaccacgccgctgctggtcgtctgcgcccagctcccggtcacccactgggcgggcaaccggctcgatctgcgccgctcgatgaccatcgggctgcttctcatcgccgccggtttcgcggtggtggccgccgcgcgccctgccgcctggacgggcacggtcggatcgctgcccgccgcgggctacgtcgtgctgctcaccctcggccagatgctggtcgtcccggccgcccgcgcctgggtgcccgacctcgccgagaacggtcggctcggcctctacaccggcgcgctgtcctccgtctccggcctgatcgtcctcatcggcagctcggccaccggcgccctgctcgacctgggcctcccgcccgccgccccctggctcgtcctcgcggccgtcccggccctcgcggtgacaccgctgccccgccgtccgaatcagcccagggtgagcagttcctcgtagaagccgccgaactcccgttcccggtcgacgaggtggatctcctggatccagtggcagcggcgtccggccttgtcggtgcgccgcagcggggtgtcgttgtcgggcgtgatgtacgactccacgcgcgcgccgtcgatcgtctcgtgcgggaactccccgaccaggtggccggcgtgccagccgcccagctcccatccggcctcggtggccagccgctcgacctcggcgtgcaaccgcttcccggtgatctccgggtcgctctcgaagaaccgcttgcctgcgtcgaagaccttgggcagatcgtcccgcagccggtgcttgaccgggtcatcgccgaggacgaaggtccggccgaagtcggcctcgtactcttcgaagatcggcccgaggtcggcgaatacgatgtcgtccgtgccgatcacccggtccggcggattctcccggtacggcaggagcgtgttcggccccgagcgcacgatccgcttgtgccagtgccgggtcgtaccgaacagctcgttcgccaggtcccggatccggtcgctgaccgcccgctccccctcgcccggcgccaccagcccgcgcccctcgatctccgcgaagagccgtacggccttcgcctgggcatccagcaaccgttccgcgcgcgtgggttcgtcgtccgccatgggcccgacggtaggctgctagatcgtttcccggcaaccgaattaggcagtcctcagtcggcccggccagtcgccgccaccgtcacgcccaggccgatcatcgcgaggccgcccgccccgccgaccatcgaaaggcggcggtccgagcgggcgaaccaggagcgggccgccgaggcgcccaggccccacagggtgtccgtgaccaggccgatggtgatcgggaccaggcccaacaccatcatctggacgggaacatgacccaccgagtggtcgacgaactgcggtagcaccgccgcgaagaagacgatgcccttcgggttggtgacgcccaccaaaatgccgtccagaatcgaacgcagatcaccacgccgctcatcggccggagcgtccatgttcgccacgcgcatctccctgcggtgccggaacgcctgcacacccaggtagacgagatacgccgctcccgccagcttcacgcccatgaacagcgccaccgagctctccaccagcgcgccgaggccccaggccacggcgatcaccagggcgtagcagccgatcacattgccgaggaccgtcgcgagcgccgtgcggcggccgtgtgcgagggccctgccgaccacgaacagcacactcggccccgggatcacgatcaccaagagcgacatcgccgcgaacgtgagaacactctccgtggacaccacgtgtccgccacctcctgaatcgctccgtccaggggacatacaagcagatggtgggttgtccgctccagacccaggcccccggccggggctcgcaagaaaggggccccggccggcgagccggctgcttacgactgagcgctggacacgggcgcgttgaggttctcgtggaccgcgcgggcgatgccctcgatgttggcgatgccgtcgtccatcgtggcgttgtcctgcgagagcaccgtgatcgtgtagtcgtggtcgccgccggtgaaggcgccgaggctgtgcacccgccagccgttcgtggcccgctccagccagccgttcttcacatgcacctgggcgtcgctcggcgcgccggccggggtgccccagcgctgcgaggggatgacctcggccgtcagcttcaggatgtaggcgcgggagtcatcgctgagcaccgggttggtgtgggtcaccagttggaggagcttttcctcatcgttcgcggtgatctgggtgagcccccagtggccctcgctgtcgagggtggtgttggtcattcccgcggcctgcaggaacccgttgatcttgtccgccccgagctgcttccacagcgcggtggtggcgtcgttgtcggactctgtgatcatggcggtggcatggtccttctcctcctgtgtcagggcgcgattgtccttctgcgcgtcccacagcagggtgctgagcacggtcaccttgaccgtgctcgcggagtcgaagtgccggtccgcatccagagtgcaggtggtgttcgtggtgcggtcgtggaggctgatcgccgtggtggcggcggagccctccagcgccgaattgatgtcctcggagagcttgtcggcgagttccggccggtccgaggtgcagatcgccgcctgcggggtggccgcgtgagccgaccccgccgaggcgatcgtcggcacgagcaccccggcggccagcaccgctcttgtcgccagggtggtacggggaggctgggttattcgtcggtgtcgacccatggtgcgcttgtccattcgttcgtggggcagttggacacgcggtgcctgcgctccgttgcgaagacatccggtgctccgaccctggatgacgagccggaggcgggtgaggttcacgaacgcgtccgagtctcacaagatcgctccacaataggcaccgcgcccgggcgggccgggcgcggtgcggcggacgaactgggcggcgacggccaggacggcgaagaacatcgagtggcccggcttccacggccgaccccggcccggcttccacggccgacccgggacccggtcagctctgaatggccgtgaggaagtctccgagggctcgcgcgacggcgccgggggcttccgcggggagcaggtggccggcgtccgggacagtcgtcagggtcgcgtgcgggatgtggggcaagaggtgttcgcgcaagatgtgcggcggctcaaccacgtcgttctccgcggccagcaccgtcaccgggacctcgatacgccgtgcggcatcggtgatgtcccgcgcgattccacgcaggggccactcctgccgggcctcggcaccggcggcgaggctgtcgcgctccgcggtggcccgcactgcctcgggcagcggtgtggcggtcaggacgtggtcgagggcgtgccccaccgtctcggccgagtcataggcgtgtgacaggccctgccggtattcctcggtcaccatggcgggcggctggggcggcgcgggcgcgacgagcaccaggccgaccaggccggccggtcggcgggccgcgacgagctggcccgccttgccgcccatcgagtggccgacgaggacgaacggccccgacacgcgctcctcgatcacacggacgagatcgtcggcgagctggtcgaggtgataggggccgggcagcgcccgcgaggtgccccagccgcgctggtcgaagcggaccgtcgcctgcccgggcggcaggtggccgatcacaccgttccaggtgtcggcggagccgccccagtagtgggcgaacaccagcgtcgggcccatatcgcccccgactcgcacgtcgagcgacccgcccgccacgggaactctcgttgtcatttccatcatcttcgcgccttccctgtcggccacggaaggcgactccgtcatcctgccgcagctctgaaccagtaacctgacctgccgatcaggctcggaatcgaccgtaggcgagggggtgtccactccttggcggaaaggaacacgttcattgtggaaaacggacacagtgcggtgcggcaactgcgctacctgcctgccgtgggatcggcgtacggggtggaggtcctcgatttcgcggcgctgcgttcgatggacacccagcgccgtcgtacccagccgcagcgccccgacttccatgtgttcgcgctggtcggttccggaaccggcagccacgaagcggacttccacaactaccggctgggggaaggcggcgccgtgtggatccggccgggcatggtgcaccgctggagcgatatcgacgcctgcgacggcccgctgatcctcttccggcccggcttcctttccggcttcacagcgtcggaggccaccgcgccggcgtgctggcacctggaccggcagcgcctgtccctcgccctgctcgcggccgaacatctcggccgcgagcacagcacggcagtgcacacaccacgcctggcatcccccgtcctgctgtcccacctgctggcggcactgatcctgcgcgcactccccggcacaccgccctcagtcggcccggcaagccccggcagccgacctaccgaagtgttccgcgcctatcgggccgccgtcgaagagcgcttcaccgactggcaccatgtggccgactacgcgcgggcattgggctacgacgtacgcaccctcacccggacaacgcgtgccgccactggcacgggcgccaagacattcctcgaccagcgcatcctgctggaggcgaaacggctgctcgcccacaccgacctgccggtcagcggctgcgcccgacgcctcggcttccgggacgtcggcaacttcaccacattcttccgtcgccaggccggcctgccccccgccgcgtggcgcgccgcatacagcaccgcaggcgcacaaggcggctgacccgccctcagcggccgggggtctggcgagtcactgtcgcggggcaggttcactgtcgcgggggcaggtgccgcaatccgttctccagcagggcgaaggcgtgttccatgtcggccaccgcacccgcatagcgctcgtcggccggctccccgtacgccaggcgttcggcgttgtcctgcgccaacgcccagtggaccgcgacgatttggacggcggcgagccgcgcggtgagttccggagtgtccgccgtttcccgcagtgcctcagtcagtgcgcgctcggcgccggtcttgaaccctgccatccgggccaccagcgagggcgcgtcgaggatcatgcggtggagcctgcgcacttcgggctggtcgttcagcccggtgatcggatcccgctcgcgcagcccctcgaggaagtgctcgcgcagtgcggtcagcggggcggtacggggcgggcgggcccgcacgacgcgtgcggattcggtctcgtggtcggccaggcggtgcaccacgaggtcttccttcgtcgggaagtaggcgaagagggtgcgcttggacacctcggccgcctcggccacctgggccaccgagacctggttgaagccgtattcgagaaacagcgagatcgccgcgtcggagatcgccgcgtgggtccgctgcttctttcgttcccgtagccctggcttgccgtccacggcgtccacggtagcagaaaactgcccctggtaaatttctgcaccgggtatatatttaccccgagtgagccgagtcggagcgttgagatgagatggagtgacggtgttgacggagagcacgaccgaggtcgttgtcgcgggtgcgggcgcgaccggactgatgctggcgtacgaactggctctggccggggtcgagaccctggtgctggagaagctgccccagcggatccagcaggtgaagggcggcacgattcagccccgtaccgccgaactgctggagtcccgcggcctgctggagccgatgctgcggcgggccattgcgcgtgatccggtgggcggcagtttcggggccctgcccgtgcccttggactgcgccccctggcggaccgagcaccccttcccgatcgggatccctcagtgggagatcgaggaggtgctcgaggagcgggcgaccgccgccggagcgcgggtgctgcgcggcaccgccgtctcaggggtcgcgccggacgacgacggtgtggtcgtcacggcggacggcctgcgggcgcgggctcactatctggtggcgtgcgacggcggccacagtacggtgcgcaaactgctcgggctgccgtttcccggcagggccggaacgcatccggcggtgctggccgatatccgtctgtccgccgtatcctcactggtgccgcggcagatgggacttatgagcaccatgacccgtcatgcgcgcggctactggtccatgctggtccctctcggcggcgaccggtaccggttcaccttcgggcacgcggaccaggcggacaccgcccgcgacacccccgtcacccacgaggagatcgcggccgcgctgcaggccgtgtacggccctgagaccaccctcggcgccgtggacaactcctcgcggttctccgacgccacgcgacaactggagcactaccgcacgggccgtgtcctgttcgccggggacgccgcgcatatccaccccccgctgggcgcccagggcctcaacctcggcgtacaggacgcgctcaacctcgggtggaaactggccgcggtcctccaggaccgggcgccgaacggcttgctggacagctaccacgccgaacggcatccggtcgcggcccaggtcctgcatcacacctcggcgcaacgcgtcctggcgatttcgaacccgagcgaggacgtggccgccctgcgcgacatcttcaccgacctgctgcggctgcccgacaccaaccgccatctcgcggggctgatgtccggcctctcgctgcgctacgacctgcccggcgatcacccgctcaccggagagcgcatcccggacgccgatctggtgaccgaaaccggcaccacccggctgtcgacgctcttcggctccggacacgccgtcctgctcgacctggccggagccgtcccggccgacctcccgctcccgccacgagtcgacctcgtccgcgccacatgcgccgacgacatgggcgccgccgccctgctcatccgtcccgacggctatgtctgctgggctacggacacctccgccgcctgcggcgacaccctgctggccgcgctcaccggcgacctcgcgagggtgccctgagccaggtgacaatgcgctgagccgggtgacaaagaggacgcctacgcgaaggccctcagggtgtcctcgccgtcggtccaccagacgccgagccgttggcggaccaggagccagccgtccgggccccggcggaattcccagtcgtaggggccgcccatggagtagggagaggaggtgctcccgggtgcggtgacggccacgaaccacatgtagccgatccccgtcgcccggtcgccctccacgtcgacgtgcatgttgaggatgtgatgctgcatgctcgcgtacggtgattccacctcctccaccttggcccggaccgcctcttttccgtggatcttctcccacggcccgaactccagcaccgcgtcctcggcccagcattcgatccaggtctgccagtccttgcggtccagcgcacgccatccgcggatcatgagggcgcgcagggcttccttgtcctccagggcgcgcagccggcgggccaggctgtcgtagtcggctgtcgctgtcatgacgggcctctttcgtccatgggtggggatctgtcctgcccgaccgagtctggaccggtcgaagaccgccgaccaggccgaacgccgcctaggagcaccgcacccaggcggcacaccggcggactcatggagggcagttgggcaacggccaggggtgagccgaccccggccatgtctccagcaggtcggggggaagatctcctcgctcgtccagcggtgtgtggtcaggccctgctcgtggtggtagcgatcccggtgcgccggcctgggtcgtgtcgtaccggaaccgtgtgcccgatccaccgtaaatccgccggacgaggcgacgtggccgccgcacgccatcgggcggccggagcggccgaagaccccttgttcccgctgtcagccgctgccgccgccgtggtcagggggaatgagggggatgtttaggggacggcccgctcgctgccggaacaagaatcacaacaacagcagcgagctttctcaagctcgttcgagctttctctcccgggccttctttcccttgggccgcgcaaccggagcgcggctgtcccgcgcaaggggcgatcccgcgcgggtcggtcgctcctcccgcgcgccctgcttcgaaccgagaggtgtggcggcatgctacggactgacctgatccggccggtgcccgaactgctccgggccaacgcggatcgcttcggtgacaagccggcctgttccgacggacaccgcacggtcagccatgccgaactcgaacgccgtacccggcggctggccggtcatctcgccgggctgcggctgcaccccggcgaccgcgccatgatctgcctgggcaaccgcgtcgagatggtggagagttacttcggcgtcctgcgggcgaacggcgtggcggtgccggtcaacccgcgttcgaccgatgcggaactctcctatctgctcgccgacagcggcgcccggctggtgctcaccgatgtcgcccacgccgaccagttcggccggctgcgggaacagttcccggagctgagggtggtggtcagcggggacggcccgctgccgaagggcttcatcgcgttcgagccgctgccggacacggagccgcagctggcagcccgcgacgacctgggcctggacgaaatcacctggatgctctacacctcgggcaccacgggcctgccgaaaggcgtgctgtccacacagcggaactgcctgtggtccctggccgcctgctacgtgccggtgacggggctgaccgccgaggaccgcgtgctgtggccgctgccgctgttccacagcctttcgcacatcgtgtgtctgctggcggccaccgccgtcggggccagcacccggatcgtggacggggtgtcgacggccgatgtgctggacgcactgcgcgaggagcggtcgaccttcatcgccggagtgccgacgctctaccaccacctgatcgaggcggcccgcgagcgcgacttcgccacgcccgagctgcggatcgcgctcgtgggcggggcggtggccacggcggacctggtcaggtcgttcgagtccgccttcggagtgccactcgtcgacgcctacggctccaccgagacctgtggcgcgatcgcggtgaactggccaaccggcccgcgggtcgaggggtcgtgcgggctgccggtgccggggctgacggtgcggctggtggacccggacaccggtgtcgacgttccggccgggcgggaaggcgagttctgggtgtccgggccgaacatcatggccgggtaccacaaccagccggaggcgacggcctcggcgctgcgcgacggctggtaccgcaccggggacctcggccgccgcgacgaggccggattctgcacggtgaccggccggatcaaggaactcgtcatccgggccggggagaacatccaccccggtgaggtcgaggccgtgctgcgcaccgtgcccggtgtggcggacgcggccgtggtgggcaagccgcatgcggtgctcggcgaggttccggtggccttcgtggtgcccggcccggacggcttcgacccgtcggcgctgctggccacgtgtcgcgagcggctgtcgtacttcaaggtcccggaggagatctacgagatcgcgcgggtgccacgcaccgcctcggggaagatcacccggcacgtactgctggagctgcccgcacggctgcgggccgccggagacggccagtacgactcgctgctgcggctggattgggtgccgcagtccgcgctgccggacgccccggccgggaccggtacctgggcactggcggacgccgacgcgctcgggctcgcggtggggctgcgggcggccggagtggacgcgcgggtggtgggcgagccggtgggcgagccggtggccgactccgtggccggtcttgtggcaggctccgtggccgatctcgctggagatgacggtgcggccccggatgtggtcgtggtgacgcctccggtggcgggcctcccggatgagaccggggcccctgacgaggccggggtcacggttggcgagcgcgccgaccggctggcggcccgccttggcgcctggctggccgacgaccggctggccgggacgacgttcgtggtggccaccacgggcgcggtggccaccggcgccgaggaggacgcaccggagccgctgtcggccgcgctgtggggtgtggtgcgctcgctgcaggccgcctaccccggccgactgacgctggtggacgtggacctggacggggccggggacagggccggggacggggccggggaggacggtcgggaggccgcgctgttgcgggccgtccagggcgggcacgaccaggcggcgatccgtggcggagtactgctggtcccgcgcctgacccggatctcgttccccgcggagccggggcccgccccaaccctggacgcgggcggactggtcgtgatcaccggtggcgacaccacccgcggcaccgcgctggcccgccatctggtgaccgcgtacggcgcccgtaacctgctgctgctcagcgcgaatggcctgccggaagaggcggcggccacgttgcggaccgagttggcgcgggacggggcccaggtctcgatggccgtatgcgacccggccgaccggacggcgctggactcggtgctggacgcacaggcccggccggtgaccgctgccgtacacatcgaggagccgagcccggaacggtcgctcgacacgtcgctgcgcgccatgacacacctggaagaacggacccggggggccgccccggcactgttcgtcgtcgtcacctccgccgccggggtgctgggctcgcctggccgcccggaccgggcggccgccgaccagttcggcgaagccctggtgcggcggcgccgggcgcttggccttggcgggctggctctggcctggggcccgctgccgggcgagcatggcacggcgccggtggccggtgccgttcccctgcccgaggcgctggccctgttcgacgcggcgctgacggctggtcaggggccgctcgtgctgctcaggccgagcacgacggggctgccgggtggcgagccggtgcccgcggtgctgcgtcatctggtggacgcgccgtccggcgtaccggcgtcggacgaacccgccgtcgcggagttccggcggcggctggccgccgagagcgagtccggccgacagcgcatggcgctggcgctggtgcgcgagcacgccgcggcgacgttggggctggcctcggccgacccggtcgaggccggccaggcattcagcgcgttcggcttcacctcactgaccgcggtcgcgttgaggaaccggctgaacgcggccaccggggcacggctcgccgccacggtggtcttcgaccatccgacccctgccgggctggcgcggcatctggtgcgggagatcaccgggaggcgcggcgtgcaggcgccggtgcgagcgcgcggcgtgtccgacgagccggtggcgatcgtggcgatgggctgccacctgccgggcgaggtcgcgacgcccgaggacctgtggcggttggtggccgacgggcgggacgcgatcgccgggttcccggaggaccggggctgggacctggccgggctcttcgactccgacccggacgccgtgggcaagtcctatgtgcgcgagggcggtttcctcaccgacgcgggcggattcgacgccgcattcttcggcatctcgccccgtgaggcgctggcgatggacccgcagcagcggttgctgctggagaccgcgtgggagaccttcgagaatgccggaatcgacccgggttcgctgcacggcaccgacgtcggtgtgttcagcggagtgatgtaccacgattacggggccgacgccgggacggcggcggagggcctggaggggcatctcggcgtgggcagcgcggggagcgtcgtctccgggcgggtggcctacgcgctgggcctgaccgggcccgcggtgaccgtggacaccgcctgctcgtcctccctggtagcgctgcacctggcggttcaggcggtgcgcacgggcgaatgctcgctggcgctcgccgggggtgtcgcggtgatgagcaggccgacgtcgttcatcgagttctcccgccagcgtggcctcgcccccgacggccgctgcaagtccttcgcggagggcgccgacggcaccaactggtccgagggtgtcgggttggtgttgctggagcggctgtccgatgcccgccgcaatgggcatgaggtgctcgccgtcgtccgtggcaccgccgtgaaccaggacggcgccagcaacggcctgaccgcgcccaacggcccgtcccaggaacgggtgatccggcaggcgctggcgaacgccgggctgacggtggccgatgtggacgcggtcgaggcccacggcacgggcacgagtctcggcgacccgatcgaggcccaggcactcctggccacctacgggcaggagcggccggaggatcagccgctgtggctggggtcgttgaagtcgaacatcgggcatgcgcaggcggcggcgggcgcggccggtgtcatcaagatggtccaggccatgcggcacggcgtactgcccaaaaccctccacgccgacgagcccaccagcaaggtcgactggacgtcaggtgcggtgtcgctactgtccgaggcccggccctggccggagacgggacacccccgccgcgccggaatctcctccttcggcgtcagcgggacgaacgcacacgtggtcctggaacaggcacccctggaagcggctgcacccgaaacacaggcgagcgacgcgggcgctcctgggctcgtggccacgggcggcgtagtgccgtgggtgctgtccgccaagactcctgcggcgctgcgcgctcaggcagagcgtctggtcagccatctggagtccgggagcgacgccaacccggtcgatgtgggctggtcgctggccaccacccgggcggcgttggagcaccgcgcggtcatcctggcgacggatgccgaaggaggcatggcgacggcgcgggctctggcggaggggcggcctgacccgctcctggtcaccggacagaccggaacagacggcaaaaccgtgttcatcttccccggccaaggcgcccaatgggtgggcatgggagcccaactcctcaacacctcacccgtcttcgccgcccgcctgcgtgagtgcgccgatgctctagcgccgtataccgactggtcgctcatcgacgtcatcaccggcacgcccgacgctccctcgcttgagcgtgtcgacgtcgtacagcccgccaccttcgccgtcgtcgtctccctcgccgcactctggcaatccgtgggcatccaccccgacgccgtcatcggccactcccaaggcgaaatcgccgccgcctgcgtcgccggacacctcaccctcaccaacgccgccaaaatcgtcaccctccgcagccagaccatcgcccaccacctcgccggacacggcggcatgatgtccctcgccacccccgccgacaccatcgacctcaccaactggcacggcaaactctggatcgccgcacacaacagccccaacgccaccgtcatcgcaggcgacaccgacgccctgcaccaactccacacccactacaccgaccagggcaccagagcccgcatcatccccgtcgactacgcctcccacaccggacacgtcgacaccatcaaaaaccagctacaagacgtactcgacggcatcaccctcgaacccggcaccatcccctggctctccaccgtcaccggacagtggatcgaacccaacaccgtcggcgacagctactggtaccgcaacctccgccaaaccgtgcaattcgagcacaccatccacaccctcgccgaccagggctaccgcacctacatcgaaatcagcccccaccccgtcctcaccaccgccatccaagaaaccctcgaagccaacgacacccccaacaccaccatcgtcaccggcaccctccgccgcgacgacgacacccccacccgcctcctcaccaacctcgcccacctcaccaccaacggaacaccagtcaactggcccaccctcttcacaggcacccaacccacccgcatccccctccccacctaccccttccaacaccaccactactggctcccccgcaacaccagcgcaggcgatgtgagtgccgtgggcctccagggcacgggccacccgctggccggggccgtggtgagcgtgcccgacaccgggggtgtgctgctcaccgggcagttgtcggtggccacccacccgtggctggccgaccacgccgtctccggaacggtgctgctgccgggcaccgcgatggccgaactcgccatccgcgccggagacgagaccgacacccccaccctggaagagctggtcatcggccagccgatgacactgcccgaagacggtgcactacatgtccaggtactggtcggcggcgtggaggacgggcgccgaggggtgcggatctactctcgccccgacgcggcccaggaacaggaatggctggagcacgcctcgggcacactcgccacgcagccggacggttcggccgagggcggcatggagaacggcatgcccgagtggccgccgcccggtgtcgagccgatcgctctggatgacttctacgacgacctcgcccaggccgggtatgagtacgggcccgccttccgcgggctgaaggcggtctggaagcgcgatggcgaggtgttcgcggaggccgcgctgccggaggagcagacggacgtcgccggccggttcggtatccatccggcgctgctggacgccgcgttgcacgcgagcaacttctgtgtgcccccggccccgggccaaacgctcctccccttcgtgtggaacggcgtacggctgctggcggcgggagccacggccgtccgtgtgcgcgcccgcgccaccggcacggactcgttcacgatcagcctgttcgacagcaccggctcccccgtcgcctcggtggactccctggtgctccgggcgatcagtcccgagcagctcgctgccgcctccggcggtgccggtcggtccgctgatgcgctgttcacgctggactggaccgagcaccccaccgccctggggaccgaggtttcctgggccaccctcggcgatgcccacaccgacgtggacgcccacgtggacgcgctcatcgcgggagaggaccggcccggggccgtggtcgccgacaccgcggcctgggccgccggggacaccggcctgcccgcgcgggcccgggatctggccgcccgcgcgctggacctggtgcagcggtgggtcggccgacccgaactcgccgacgtccggctcgtgttgctcactcgtggggcggtgtccgtgcacgacaccgccgaggtcaccgacccggccgccgccgcgatctggggcctggtccgctccgcccagtccgaacacccgggccggatcgccctggtggacaccgacgacgtgtcgcgggaggcgctgcccgaggcggtggcggccggcgagccgcaagtggcgctgcgccgtgggctgctgtgggtgcctcgtctggtgcggtcgccgcagggtctcgccgtacccgcgcacgagcactggtacctcgacgtctcggagaagggcagcctggagaacctggtgctgcggccggatccggaggccaccgcgccgctggccaccggtcaggtccggatcgaggtccgcgccgccggtcagaacttccgggacgtactcgtcgcgctcggcggcgtggcgggtcaggagggtctgggcggcgagggtgccggggtggtgaccgaggtcgggcccggggtcgagggcctggcggtgggcgaccgggtgatgggcctgttcccgcgctcgttcggcccgctggccatcgcggacgcgcgcacggtcgcgccgatccccgagggctggtcgtacgccacggccgccggggtgccggtggcctatctgacggcactgtacgggctgcgggacctgggcaccgtacagccgggtgagacggtgctggtgcacgccgccgcgggcggtgtgggcatggccgccgtccagttggcgcggcacttcggcgccaccgtgtacgccaccgcccacccgtcgaagcaccatgtgctgaccgcgctgggggtgccggaggggcatctggcgtccagccgcgacctcggtttcgcctcggcgtttcccgcgctggatgtggtgctgaactccctcaccggcgagtatgtggacgcctcgctggggctgctcggcacgggtggccgtttcgtggagatgggcaagaacgacatccgcgatcccgcctcggtcgccgcagcacatcccggtgtgggctatcaggcgttcgacctgggaggtgacgcgggccctgaccggatccgggagctgctcgcggagctggtggaactgttcgaggcgggccggatcgagccgcttccgatacggcactgggacgtcacccaggcgccgacggccttccggtggatgagccaggggcggcacaccggcaagatcgtgctcaccctcccccgagccctggacccggacggcaccgtcctgatcaccggtggcaccggaaccctcggcgccaccatcgcccgccacgtcgtcacccaccacggcgcgcgccagttgctcctcatcagccgtcagggtcccgacgcccccggcgccaccgatctcaccaccgaactcaccgaactcggcgccaccgtccgcatcaccgcctgcgacaccgccgaccgcgaccaactcgccgcgctcctcgccgacatccccgccgcccaccccctcaccgccgtcatccacaccgccggcgccctggacgacggtgtcctgaccgcgctcaccccggaccgcctcgacaccgtcttccgccccaaggtcgacgccgtcacccacctccacgacctcacccgcgaccaggacctggccgcgttcgtcatctactcgtccgccgccggaacgctcggcaacgcggggcaggccaactacgccgccgccaatgccttcctcgacgccttcgcccagtggcggcacgcccgccaccggcccgccacttcgctggcgtgggggctgtggagcgacaccagcacgctcacctcgacgatggacgccaccgacgtacgccgcacacggcgggcgggggtgctgggcatggacaacgccgaggcgctgcgggtgttcgacaccgggttgcggtccgggcggcccgcgctggtggccgcgaagatcgacctcaccgccctgcgcgcgccggacgccgagttgtcgccgctgctgcgcggactggcccgtccggcgcgccgcaccgcgcgcaccgcggccccggcggccggtggtctgtcggggcagctggccgggctgtcccccgccgggcagcgggagttcctgctcaacctggtgcgggcggaggccgcggtggtcctcgcccacgccggtcctgaggcgatcgagccgaccgtggcgttcaaggagatgggtttcgactcgctgacggcggtcgaactgcgcaaccggctgaatgcggcgaccgggctgcggctccccgccacgttgctcttcgaccacccgactccggctcttctcaccgagctgttccataccgagttgggcggcggcccggcacccgccgcggcggccccggtgaccgtgcgtgccgccgctgacgagccgatcgccgtggtggcgatgagctgccgtctgccgggcggggtgaccgacccggacgggctgtggaacctgctgctcgaagagcgcgacggcatcgccgacttcccccgcgaccggggctgggacttggaggcgctgttcgacgccgacccggaccggagtggcacctcctatgtgctgcgcggcgggttcctcgaggacgcggccggtttcgacgcggacttcttcggcatctcgccacgtgaggcgctggcgatggacccgcagcaacggctgttcctggaagcctgctgggaggtgttcgagcgggcgggcatggacccgacgacggtgggtggcggcgacatcggcgtgttcgccggcgtcatcaaccaggactacggcgtgcggagcgggcccgctcccgaggaccttgagggctatatgctcaccggctcggcgacgagtgtcgcctccggccgggtggcctatgtgctgggcctggagggcccggcggtgacggtggacacggcgtgctcctcctcactggtggccatgcactgggccgtacaggcgctgcgccagggcgagtgctcgatggcactggccgggggtgccacggtgatggggcggccgtcggcgttcgtggagttctcgcgccagcgtggcctggcgccggacggcctgtgcaaggcgttcggcgcgggtgccgacggcaccaccttcagcgagggtgtcggggtactgctgctggaacggctctccgacgcccgccgcaacggccacgaggtgctggccgtgatccgcggtacggcggtcaaccaggacggcgccagcaacggcctcaccgcccccaacggcccctcccaacagcgggtgatccggcaagcactcgcgaacgccgggctgtcggccaccgacatcgacgccgtcgaagcccacggcaccggcaccgccctcggcgaccccatcgaagcccaggcactcctggccacctacggccaggaccggccgggagacgagcccgtatggctcggctcgctgaagtcgaacaccgggcacacgctggccgcggcaggcgtgtccagcgtcatcaagatggtgctggcgatgcggcacggcacgcttccgcgctccctgtacgccgacgagcccacgccggaagtggattggtcccagggcgcggtgtccctgctcacggaggcccggccctggccggagacgagccacccacgccgcgccgggatctcctccttcggcatcagcggcaccaacgcccacctcatcctggagcaggcgccccagtccgagaccgagcccgaagccgcgccgaaggcggacggcggcatggacaccccagggctcgtggcgaccggcgggagcgtgccctgggtgctgtccgccaagacccccacggccctgcgggctcaggctcaacgactcctggaccacctggaatccggggtgaccgaccgccccctcgacatcggctggtccctggccaccacccgcaccctccacgaccaccgcgccatcatcctcaccgacaccgagggcggtgacgccacagccgccctcaccgccctcgcgaccggacaaccccacccccgcctcaccaccggccacgccaccacccacggcaagaccgtcttcgtcttccccggccaaggcgcccaatggcaaggcatgggagcccaactcctcgacacctcacccgtcttcgccacccgcctccacgaatgcgccgacgccctcgccccctacaccgactggaacctcatcgacgtcatcaccggcgcaccccacgccccttcgctcgaccgcgtcgatgtcctgcagccgaccaccttcgccatcatggtctccctcgccgcactctggcaggccaacggcatccaccccgacgccgtcatcggccactcccaaggcgaaatcgccgccgcccacatcgccggacacctcaccctcaccgacgccgccaaaatcgtggccctgcgcagccagaccatcgcccaccacctcaccggacacggcgccatgatgtccgtcctcgcctcccacacctgggttcaagaagcactggctccctggcacggacacctgtggatcgcagccgtcaacggccccgcctccgtatccgtctccggagaccccgacgcactcgccgaattcggtgtcaccctctccaaggcgaaggtctaccgctggcagttgcccggggtggacttcgccggacactccggacacgtcgacaccatcaaagaccagctacaccacgtactcgacggcgtcaccgcctcccccggcaccgtggcctggatgtccaccgtcgacgccgactgggccaaccccacacacatcgacgcccactactggtaccgcaacctccgcgacaccgtccgcttcgaagaagccacccgagccctcctcacccacggccaccgcgtcttcatcgaaatcagcacccaccccgtcctgaccaccgccatccaggacaccaccgaaaccctccccgaggtccgggccaccatcaccggcaccctccgccgcgacgacggtggccccgaccgcgtcctcacgagcctcgcggagctctccaccgccggaattccggtccactggcccaccgcgtacgccggaaccacaccctcccaagtccccctgcccacctaccccttccagcaccagcactactggctggccgccaccggccaccacggggatgtcggctccgtgggactgcgcgacgcggcgcacccgctgctgggggccgtggtcagcgtgccggacaccggaggggtgctgctcaccgggcggctggcaccgtcggcgcagtcctggctggccgaccacatgctgtccggcgtcgccctggtgccgggtacggcgatcgtggaactggccgtacgggccggggacgagacgggcacgccggtgctggaggagctggtcctcggccagccgatgcttctccccgaggacggctcgcttcaggtgcaggtcctggtcggcgctgccgaggacgacgagcgccgtgcggtgcgtgtctactcccgcggcgacgagtccgagccgtgggtcgagcacgcgtccggcatcctgtccgcgcacgcgctcgttcctgtcgaggcagagcggcagtggccgcccaccggggcggagcccgttgtcctggagggcttctacgaccgcctggcccaggcaggctatgagtacggtccggtgttccgcgggctcaccgcagcgtggacccgcggcgatgatgtgttcgccgagatcaccctcggcgaggaccagcacgacctcgcgggccgcttcgggatccatccggcgttgctggacgcggcactgcacgcgagcaacttctgcccgggcaacgagcccggcggcgggacgtatctgccgttctcctggaacggcgtgcagttgcacgccgacggcgccaccgccctgcgggtgcgggtcacctccaccgggccggacaatctgtccctgcacgcgaccgatccgcacggggtgcccgtggtgaccgtcggctcgctggtgctcagggagaccaccgcggagcagctccgcaccacatcggccacgtccgccgcggactcccagttcaccgtggagtggaccgaacatcccctggcccgggacgaggtggcgtgggcggcgctggaggccgtgcaggacgacgatacgtggccgccggtggtcgtcgccgacacccgggcgttcgccgcgcagggcggcggactgccggacgagggcggactgcaggaggacggcgaactaccggagcgcgcccgtgagctgaccggccgggcactggccgcgatacagcgtctgatcagcgacgacgcactcgccgacagccgcctgacgctgctcacccggggtggcatggcggtgcatgacgacaccgaggtcaccgacccggccgccgccgcggtgtggggcctggtgcgcgccgcgcaggccgagcacccgggccgggtgtgcgtgatcgacatcgacgaccggtcggccgaggccctgaccgccgcgctggccacggaggaaccccagctcgcgctgcggggcggaaccgcgtgggtgccccgcctggtgcgagcgcgcccgggactggcggtcccggcggccgtggcgtggcatctggacgtcaccgaacacggcacgctggagaacctcgccctggtgccccatccccgggcggaggcaccgctggaggcgggccaggtgcggatcgcggtgcgcgccgccggccagaacttccgcgatgtgctcatcgccctcggcatgtacgaggcggagatcggcaccgagggcgccggcgtggtgaccgaggtcggcccgggcgtggcggacctgaccgtgggcgaccgcgtgatgggcatgttgcccggttcgttcgggccgctggtggtggcggaccggcggacggtggtgcggatgccgcgcggctggtcgttcacggctgcggccggggtgccggtcgcctatctcaccgcgttgtacgcgttgcgggatctgggcgatgtccagccgggtgagacggtgctggtgcacgccgccgccggtggtgtcggcatggccgccgtacacctcgcccaccacttcggcgccaccgtcctcgccaccgcccacccggccaaacaccacagcctggaacagctcggggtgcccacggaacgacgcgcctccagccgcgacctcgcctacgcccgcaccttcccgaccgccgacatcgtcctcaactccctcaccggcgaacacatcgatgcctccctcgggctcctggcccccggcggccgtttcatcgagatgggacgcaccgacatccgggacgtggacgaggtgcgcgcgtcccatccggaccggacatatcgcgcgttcgacctgggcgcggacgctgggccggaccgcatccaggagctgctggccgagctggtggacctgttcgagcagggcctgatccctccgttgcccacccggccgtgggagatcacccgcgcccccgacgcattccgctggatgagccagggccgccacaccggcaagatcgtgctcaccctcccccgcatccccgaccccgagggcaccgtactgatcaccggcggcaccggcaccctcggcaccgccatcacccgccacctcgtcacccaccacggcgtacgcaacctggtcctcgccagccgccaggggccgaacgccctcggcgcggccgacctccacgacgaactgaccgcactgggcgcacaggtacgcatcaccgcctgcgatatcgccgaccgcggccaactcgccgcgctcctcgccgacatcccgtccgaccaccccctcaccggcatcgtgcacaccgccggcgccctggccgacggcaccctcaccacactcgaccccgaccgcatcgacaccgtcttccgccccaaggtcgacgccgtcacccacctgcacgacctcacccgcgaccaggacctggccctcttcgccgtgtactcctccgccgccggaatcctcgggaacgcgggtcaggccaactacgccgccgccaataccttcctcgacgccttcgtacagcggcggcgcgcggcggggctcgccgggctgtcactggcctggggcctgtgggcggagaccagcgacctgtcggccgcgctgatcacggccaaccgggatcgcacccaacacggtgtcgtccgcccgatggccaccgagcacgccctgagcctcttcgactccgcgctcggcctggggttgtccctggtggtaccggcgaagctggacccgggcgcgcacgagtccgccgcgggcgctgtgccgccgctgctcaccggcctcctccggccgacccggcgcaccttgcggtccacggcgggccaatccggcgaaggcggtctcacggcccggctggcggcgctgtccgaggccgaccagcaccggctgctgctggacctggtacgggaccatactgcgaccgtactcgggcacgccgggaaggacgccgtggacgccaggcgcgcgttcagcgagatcggggtcgactcgctcatcgcggtggaactgcgcaaccggctcgccggcgcgaccgggctgcgcctgcccgcgacggtcgtgttcgactacgcgacaccggaggcgatggccgggcatctgcggtccgtggtggccggagacacggccgcccctgcctccccgtcgacgtcggcggtggcgcccgcttccgcggtggccccggcggacgacccggtggccatcgtgtcgatgaactgccggctgcccggcaaggtcaccggccccggggagctgtgggatctggtgtcccagggccgggacgcgatcggcccgttccccacggaccgcggctgggacgtggagacgctgttcgacctcgatccggacgccgtgggcaagtcctacgtacgcgagggcggtttcctcaccggcgccggcgacttcgacgccgagttcttcggcatctcgccgcgtgaggcgctggcgatggatccgcagcagcgactgctcgccgagacctcatgggagctgttcgagcgggcgggcatcgacccggtgtccgtgcgcggacaggccatcggggtgttcgccggggtcatcgaccagggatacatcgcccactccgaggcccctccgccggagttggagggctacctgatgacgggcagcaccacgagtgtggcctccggccgagtggcctacctgctgggcctcgaaggccccgcggtgacggtggacacggcgtgctcgtcgtcgctggtggcgctgcatctggccgtgcaggcgctgcgggcgggcgagtgctcgatggccatcaccggtggcgtgacggtgatcgccaagcccggcggtttcatcagcttctcccgccagcgcgggctcgcgccggatggccgcagcaagtccttcagcgagggcgccgacggcaccagcttcagcgagggcatcggtctggtgttgctggaacggctctccgacgcccgccgcaacggccacgaggtcctggccgtgatccgtggcacggcggtgaaccaggacggcgcgagcaacggcctcaccgcgcccaacggaccctcccagcagcgagtgatacggcaggcgctggcgaacgccgggctgacggtggccgacgtggacgcggtcgaggcccacggcaccggcaccgccctcggcgaccccatcgaggcccaggcactcctggccacctacggccaggaccggccgggggacgaaccgctgtggctcggttcgctgaagtccaacatcgggcacacccaggccgccgcgggcatcgcgggcctcatcaagatggtgctggcgatacggcagggcacgcttccgcggtccctgcacgccggcgaacccaccaccaaggtcgactggacgtcgggcgcggtgtcgctgctgtccgaggcccggccctggccggagacgggacacccccgccgcgccggaatctcctccttcggcatcagcgggacgaacgcacacgtgatcctcgagcaggggccggaggtggctgtgcccgcaacggaggcgcgcgacgcgggcgctcctgggctggtggccacgggcggcgtggtgccgtgggcgctgtccgccaagagccctgcggcgctgcgggcccaggccgagcgtctggtcagccacctggaatccggggacgctccgcgtgcggtggacgtgggctggacgctggccaccacccgagcggcgttggaacaccgcgcggtcatcctcgccaccgacaccgaagacggcatcgccaccgcccgcgccctggcggagggacggcctgacccgctcctggtcaccgggcagaccgggacggacggcaagaccgtgttcgtcttccctggtcagggggcccagtgggtgggcatgggagcccaactcctcaacacctcacccgtcttcgcggctcgcttgaacgaatgtgccgaggccctggccccgtataccgactggtcgctgatggacgtcatcaccggcgctcccggcgccccttcgctcgagcgtgtcgatgtcgtacagcccgccaccttcgccgtcgtcgtctccctcgccgcactctggcaatccgtgggcatccaccccgacgccgtcatcggccactcccaaggcgaaatcgccgccgcctgcgtcgccggacacctcaccctcaccaacgccgccaaaatcgtcaccctccgcagccagaccatcgcccaccacctcgccggacacggcggcatgatgtccgtcctcgcctcccgggaacaggtcgaggaagccctcaccccgtggcacggcaaactctggatcgccgcacacaacagccccaacgccaccgtcatcgcaggcgacaccgacgccctgcaccaactccacacccactacaccgaccagggcatcagggcccgcgtcatccccgtcgactacgcctcccacaccggacacgtcgacaccatcaaaaaccaactccaccagaccctggccgacaccacgaccgagcccggcaccatcccctggctctccaccgtcaccggacagtggatcgaacccgacaccgtcgacagcggctactggtaccgcaacctccgccaaaccgtgcagttccacaccgccatcaccgccctcgcccatgagggctaccgcaccttcatcgaaatcagcccccaccccgtcctcaccaccgccatccaagaaaccctcgaagccaacgacacccccaacaccaccatcaccggcaccctccgccgcgacgacgacacccccacccgcttcctcacccacctcgcccacctcaccactcacggccacacccccgactggaccgccctctactccgccacccacccccgccccacgcccctccccacctacgccttccaacaccaccactactggctcacgccgtccgaggtaccggaggcggtggccgacggtgtgttctgggacgccgtggagcggggcgacctcgcctccctggccgattcactcggcgtcgaggagaagacgctggagcccgtgctgccggggttgacgtcgtggcggcgccgcaaccaggaccagtccaccgtggacacctggtcgtatcgcatcgcctgggatccggtggcgaccggagaggcgcccgtactgccgggagcgtggctggtggccgtggcctcaccgcaggcgagcgacgccgcggtgacggacgtggtggccgcactggccgcgcacggtgccgatcccgtggtggtcgaggtcgacacggtggaacaggcggaggtgaccgcgcgcctgcgggagcggatatccgattccgatgacgagtacgccggagtggtgtccctgctggcgtgggacgagcggagctacgaacccggcacgctctcccggggcgtggcggccacggtggcgctgatacaggccgtggaggagatcgggctcgccgctcccctgtggtgcctgacgcgtggcgcggtcgccgtgcgtgagccctccgaggtgaccagcgagttccagccgctggcctggggaatgggcgtggtgcaggggctggatcagccgtccacctggggcgggatcgtggatctgccgcggacgccggacgagacggcccttgtccggttgtgctcggtgcttgccggagtggacgcggaggaccaggtcgcggtgcgcgcgtcgggggtgttcgcccggcggatgcggcgcgaaccggtgacgtcggcaccggcgtggcagccacgggacacggtgctgatcaccggtggcaccggcgggctcggttcgtacgtgggccgttgggccgcgggtcacggcgcccggcgtgtggtgctgctcagccgtcagggtgcgcaggcgccgggcgcggcggagctggaggccgagctgagcgcactgggcgcggatgtgaccatcgcggcgtgtgatgtgaccgaccgggaccagctagcggccgtcctggcggagatcccggatgacgcgccactgtcgggcgtggtccacgccgcggggctggcgctgccggagaagccgctgtcgaagatgacactcgccgagttcgccgacatcggccaggcgaagatcgccggtgcgcggcatctcgacgacctgttgggggagcgggagttggacgccttcgtcctgttctcgtccggagcggcggcctggggcagcggcggccagagcgcctacgccgccggcaacgcctacctcgacgggctggcgcagcgccgccgcgcacgggggctggcggccacgtcggtggcgtggggcgcctggggcggtggccttggcacgatcgacgagatgatgggcgcgcagtggcgccgtacaggtctgatgaccatggacccgcggctggcggcgctggcgatggcacacaccgtgggcagcggcaccgcccacggtgtggtggccgacatcgactgggaacggttcgcccccggctacaccatggcccggttccggcccctgctgcggggactgcccgatgtcatcgacctgctgaccgaggacgcacccgaggacagcgcgggacagacggagctgatcgcacggctggccggactgagccccgaggatcaggagcggctgctcaccgagctggtgcaggccgaggccgcggccgtactcggacacgtgagcgccgacgccaccggggaccgtccgttcagcgagatcggattcgactcgctgacggcggtggagctgcgcaaccgcctcaatgccagcacggggctgaggctgcccgcgacgatggtgttcgaccacccgcggcccagtgtgctggcacgccgtatccgcaccgaactcggccataccgacacctcgtcggtggactcggtgctggccgagctggagcggctggaagcacatttggcggcgctgccgaaggagaagatcgaacgcgcccggatcacctcgcggctccagcggatgaccaccaaggtcgccgagatcgaggccgtcggcacgggcggcgacaccgtcaccgaacgactcgacacggcgaacgccgacgacgtgttcgccttcatcgaccaggagttcggcgtggactgattccccgtctcgtctccgctcaccgatttcacccacgaggctcttggcgaggtccagatggcgaatgacgaaaagctcctcaactacctcaagcgggttaccgccgacctgcaccagacgcgggaacggttgcgcaaggccgaggcggcgacggaggagccgatcgccatcgtcggcatgggctgccgcttcccgggcggcgtgaccaccccggacgggctgtgggatctggtggccgacggccgggacgcgatcgccgggtttccggaggaccgcggctggaacctggagaacctcttcgacgccgaccccgactccgtcggcacctcctatgtgcgcgagggcggcttcctcaccgacgcggcggagttcgacgccgagttcttcggcatctccccgcgtgaggcgctggccaccgatccgcagcagcggctgctgctggagaccgcgtgggagaccctcgagcacgcgggaatcgacccgagttcgctggaggacagcgacgtcggcgtgttcaccggcctggccaacggcgactacgcgctgaccgtggaccaggtgccggaaggcttcgaggggtatctgggccttggtggcgcgggcagcatcgcgtccggccgtatctcgtactcgctcggtctgctcggcccggcggtcactctggacaccgggtgctcctcgtccctcgtggcgatgcacttggccagttatgcgctccggtccggggagtgctccatggcgctcgccggtggggtgatggtgatggcgacccctggcggcttcgtcggattctcccggcagcgggggctggcgcgcgacgggcgctgcaagtccttcggtgagggcgccgacggcaccaactggtccgagggcgtcggtcttgtgctgctggagcggctgtccgaagcccaccgcaacggccacccggtactcgcggtcatccgtggcacggccgtcaaccaggacggcgcctccaacggcatcaccgcgcccaacgggccgtcccaggaacgggtgatccggcaggcgctggcgaacgccggactgtcgctggccgatgtggacgcggtcgaagcccacggcaccgggacgagtctcggcgacccgatcgaggcccaggcactcctggccacctacggtcagaaccgcccggaggatcagccgctgtggctgggctccatcaagtccaacatcggccatacccaggccgccgcgggtgtcgcgggcgtcatcaaaatggtccaggccatgcggcacggcgtactgcccaaaaccctccacgccgacgagcccaccagcaaggtcgactggacgtcaggtgcggtgtccctgctgtccgaggcccggccctggccggagacgggacacccccgccgcgccggaatctcctccttcggcgtcagcgggacgaacgcacacgtggtcctggaacaggcacccctggaagcggctgcacccgaagtagacgtagacgaggcgggcgctcctggactggtggccacgggcggcgtggtgccgtgggtgctctccggtaagactcctgcggcgctgcgggctcaggcggagcgtctggtcagccacctggaatccggggacgctccgaatgcggtggacgtgggctggtcactggccaccacccgggcggcgttggagcaccgcgcggtcatcctggccacggacaccgaaggaggcatggcgacggcgcgggctctggcggagggacggcctgacccgctcctggtcaccggacagaccggaacagacggcaaaaccgtgttcatcttccccggccaaggcgcccaatgggtgggcatgggagcccaactcctcaacacctcacccgtcttcgccgcccgcctgcgcgagtgcgccgatgctctagcgccgtataccgactggtcgctcatcgacgtcatcaccggcacgcccgacgccccatcgctcgaccgtgtcgacgtcgtacagcccgccaccttcgccgtcgtcgtctccctcgccgcactctggcaatccgtgggcatccaccccgacgccgtcatcggccactcccaaggcgaaatcgccgccgcctgcgtcgccggacacctcaccctcaccaacgccgccaaaatcgtcaccctccgcagccagaccatcgcccaccacctcgccggacacggcggcatgatgtccctcgccacccccgccgacaccatcgacctcaccaactggcacggcaaactctggatcgccgcacacaacagccccaacgccaccgtcatcgcaggcgacaccgacgccctgcaccaactccacacccactacaccgaccagggcaccagagcccgcatcatccccgtcgactacgcctcccacaccggacacgtcgacaccatcaaaaaccagctacaagacgtactcgacggcgtcaccctcgagcccggcaccatcccctggctctccacggtcgacggacagtggatcgagcccagcacggtcggcgacagctactggtaccgcaacctccgccagaccgtgcaattcgagcacaccatcaccaccctcgccgaccagggctaccgcaccttcatagaaatcagcccccatcccgtcctcaccacctccatccaagaaaccctcgaagccaacgacacctccagcaccatcgtcaccggcaccctccgccgcgacgacgacacccccacccgcctcctcaccaacctcgcccacctcaccaccaacggaacaccagtcaactggaccaccctcttcacaggcacccaacccacccgcatccccctccccacctaccccttccaacaccaccactactggctcccccgcaacaccaacgcaggcgacatcgcctcggccggtctccacgaccccgggcacccgctgctcaccgccgccgtccacctccccgacaccggtggcaccgttctcaccgggcgcctctccctgaccacccacccctggctggccgaccacaccgtgtccggcgccgtcctcctccccggcgccgcgatggccgaactcgccatccgcgccggagacgagaccgacacccccaccctggaagagctggtcatcgagcagccactggcgctgccggacagtggcttcctggacatccgggtggtcgtgggcggccctgacgagtccgggcgtcgggacgtacgcatctattcccgcgccgaagaagaaaccgcgcagtggacggagcacgccaccggcacgctggctcaggacaccacggctcctccgtcgcccgccgtcgccgaatggccacccgccggtgccgagccggtggccgtcgaggggctgtacgagcagatggccgaggggggctacgactacgggccgaccttccagggcctgaaggcggtatggacccgcgacggcgaagtgggcgaggtgttcgcggaggccgcgctgccggaggagcagacggaggccgccggccggttcggcatccacccggcactgctggacgccgcattgcacgcgagcaactactgcctgcccggggaacccggtagccgcatgctgctgccgttcgcgtggaacggcatacgcctgcacgccaccggtgccacgtcggtgcgcgtgcacgcccgttacaccgaggacggcgggctctccgtggtcctggtcgacgcagccggcgggctggtcgcgtcgatcggttcgctggttctgcgggaggtcgacgcggcgcagctcgaagcgctgacctccacgtcggtgaacgactcactctggacggtcacttggaccgaacacaccgccaccacggacgagatccggtggggcaccgtcggggacgtctcacccgtcctcgccgccgccgaagccccggccttcgccgatgtcacagagatcgccacggggcccgccatcgggatgggcacggagatcgccggggccgaggagcggcccgcgctggtcgtcgccgacaccaccgtatgggagtcccgggacgccgaccccatcacgcgggcgcgggagctggccacgcgggcactggacctgttgcagcggtgggtgaccctgcctgagctgtcggaaacacggctggcggtcctcacgcgcggtgcgatggccgtacacgactcgtccgaggtcaccgaccctgccgcggcggcgatctggggtctggtccgctcggcccagtccgaacaccccggccgcgtccacctcatcgacaccgacggccactcggaccacgcactgcgcagcgcactgcccaccgcactcgccaccgaccagccccaactggccctccgcgacaacacgctctgggcgccccggctcaccgccgcggcacccgtcggcacaccggcccagccgctccccctcgaccccgagggcaccgttctcatcaccggcggcaccggcaccctgggcgccctcaccgcccgccacctcatcacccaccacggcgcccggcacctgctgctcaccagccgccagggtccctacgcccccggcgccacggacctcaccaccgaactcaccgaactcggcgccaccgtccacatcaccgcctgcgacaccgccgaccgcgaccaactcgccgccctcctcgccaacatcccggccgcccaccccctcaccgccgtcgtccacaccgccggaaccctcgacgacgccctgctcaccgacctcaccccgcagcgcctcgacaccgtcttccgccccaaggtcgacgccctcacccacctccacgacctcacccgcgaccacgacctgaccgccttcgtcatctactcctccgccaccggcaccctcggcacccccggccaggccaactacgccgccgccaacacctacgccgacgccctcgcccaccagcgccacgccaccggactccccgccacctccctcgcctggggcctatgggaaaccaccagcgccctcaccgccaccatgaacaccgaggaccgccggcgcacccaccgcggcggcgtggcccccctcaccgacgacgaggggctcgtcctcctcgacacggccctcaccgccacccaccacccccacctcgtcccgatcaagatcagcccggcctccctgcgagccgatgacacggcgcggcccgttcccccgctcctccgccacctcgtacgacgccccacgcgccgcacggcccacacaccggccccagcggacaccctgtcgctcacccgacggctcgccgccctcgaccacggcgaacggctacggcacctcatcgagctcgtccgcaccgaggcggcagccgtgctcggacacccgacgatcgacagcatcggaccggaccagcccttccgggacgccgggttcgactcgctgacggcggtggaactgcgcaaccgcctcaatacggccacgggactgcggctccccgcgaccgtggtgttcgactacccgacctcggcgatcaccgccgggtatctgcgggacgagctgttcggctcgacggaggcggctccggccgccgtcgccgggcggggggccgacgcggacgaccccgtggtcgtcgtcggcatggcctgccgactccccggacgggtgaccgacccggacgggctgtggcggctggtggccgacggggaggacggcatcggggcgttccccaccgaccgcggttgggatctggacacgctgttcgaccccgacccggaccgggtgggcgcgacctacgtccgcgagggcgggttcgtggcgggtgccaccgagttcgacgcggacttcttcggcatctccccgcgtgaggccgtggcgatggacccgcagcaacggctgttgctggagaccgcgtgggagaccttcgagcaggccggtatcgccccgcggtcggtgcagggcaccgacaccggcgtgttcgccggggtcatctaccacgactacgggacgaacgccggtgagctgcccgagggctcggagacctatctgagcacgggcaaatcggggagcgtggtgtccgggcgggtcgcctacgcactgggcctgaccggtcccgcggtgacggtcgacacggcgtgctcctcctcgctggtggccatccactgggcggccaaggcggtgcgggagggcgagtgctcgatggccctggccgggggcgtgacggtgatgtcgaccccggaggggttcgtgagcttctcgcaccagcgtgggctcgcccccgatggccgcagcaagtccttcggcgagggcgccgacggcaccaccttcagcgagggtgtcgggctcgtgctgctggaacggctctccgaggcccggcgcaacggtcacgaggtgctggccgtgatcgccggtacggcggtcaaccaggacggcgccagcaacggcctcaccgcccccaacggaccctcccagcaacgggtgatccggcaagcactcgcgaacgccgggctgtcggccaccgacatcgacgccgtcgaagcccacggcaccggcaccgccctcggcgaccccatcgaagcccaggcactcctggccacctacggccagaaccgccccgccgaccagcccctctggctgggctcgctgaagtccaacatcggccacacccaggccgccgcgggcatcgcgggcctcatcaagatgatccaggccatgcggcacggcatgctgcccaggacactccacgccgacgagcccaccaccaaggtcgactggacatcgggcgcggtgtccctgctgacggaggcccgcccctggccggagaccggccacccacgccgtgccgggatctcctccttcggcgtcagcggcaccaacgcccatctcatcctcgaacaggccccggaagacgcggccaccgcaccagaaatcacggaaccggaggctcccgggctggtggccacgggcggcgcggtgccgtgggtgctgtccgccaagagccccacggccctgcgggcgcaggccgaacgcctgatcgcccaccttcacgcccaccccgagatcgacccggtggacatgggctggtcactggccaccagccgcgccgccctggaacaccgcgcggtcgtcctcgccaccgatctcgaccaggcgaccgccgccctcaccgctctcagcgaggggcagccgcaccccggcctggtcaccggggagacgggcagcgacggcaagaccgtcttcgtcttccccggccagggcgcccaatggcaaggcatgggagcccaactcctcaacacctcacccgtcttcgccacccgcctccacgaatgcgccgacgccctcgccccgtataccgactggtcgctcatcgacgtcatcaccggcgcacccggcgcgcccagcctcgaccgtgtcgatgtcctgcagcccaccaccttcgccatcatggtctccctcgccgcactctggcaggccaacggcatccaccccgacgccgtcatcggccactcccaaggcgaaatcgccgccgcccacatcgccggacacctcaccctcaccaacgccgccaaaatcgtcaccctccgcagccagaccatcgcccaccacctcaccggacacggcgccatgatgtccgtcctcgccccccacacctgggtccaagaagcactcaccccctggcacgaacacctgtggatcgccgccgtcaacggccccgcctccgtatccgtctccggagaccccgacgcactcgccgaattcggtgtcaccctctccaaggcgaaggtctaccgctggcagttgcccggggtggacttcgccggacactccggacacgtcgacaccatcaaagaccagctacaccacgtactcgacggcgtcaccgcctcccccggcaacatcgcctggatgtccaccgtcgacgccaactggaccaaccccacacacatcgacgcccactactggtaccgcaacctccgcgacaccgtccgcttcgaagaagccacccgagccctcctcacccacggccaccgcgtcttcatcgaaatcagcacccaccccgtcctgaccaccgccatccaggacaccaccgaaaccctccccgaggtccgggccaccatcaccggaacgctgcgccgcgacgacggcggccccgaccgcgttctcgcggggctgggagggctgttcgcggccggggtgccggtggactggggcgccctgttcgccagtaccggggcccgtcgggtgccgctgcccacgtacgccttccagcaccggcactactggctggagcccgccaggacaccgacgcgggccgagagcgccgacggctccctgtgggcggccatcgaggacggagacgcgcagtctctcgcgcgggatcttgatgtggacgcggcggccctcggcacggtgctgcccgcgctcgcctcatggcgtcggcgcagccgggaggactccctcacggacgcatggcggtaccggatcggctggacccgggtggccacggccgacccgcagttgtcgggccggtggctggtgctggtcccggccgtgcgggcgggctcggcgcgggtccgtgcggtgctggacgggctggccgcgcggggcgccgaggtggtggccgccgaggtctccgaaaccggccgggaggcactgggcgaccaggtcaagtcggcggacggcggtgccggggtggtgtccctgctctcgtgggacgaccgcgccgacaccgagtacggcaccgtgtccacgggcaccgccgcgacgctcgcggtggcacaggcgttgcgggaccacggcgtcaccgctccgctgtggtgcgtcaccagtggcggggtcgcggtggccggtgaggcggccgacccggtgcagtccgcggtgtggggattcggcgccgtactcgggctcgaccacccggacaccttcggcggcctgatcgatctgccggccgaaggggagggtgacgacgaggcgttgccggacgggctgttcgcggcgctgtcgtcccccgagggggaggaccagctcgcggtgcgcgccgacgggctgttcgcacgccggatggtgcgcgaccgggacggctccggcagcccctggaagccgcgcggcaccgtgctggtcacgggcggcaccggcgggctcggttcgcatgtggcgcgctggctcgccacgagcggggcggaccatgtggtgctgctcagcaggcagggtggtgacgcgccgggcgcggccgaactggtggcggacctggcgggggtggaggtcacgctcgccgcgtgtgatgtgaccgaccgggacgccgtggccgcggtgctggccgaagcggagcggacccatccgctgaccgcggtggtgcacaccgccggtgccgggctgccctcggctccggtcaccgaggtgaccaccgaggagttcgccgccgtcacgggggcgaaggtgcgcggcgcgctggtgctggacgagctcgtcggcgaccgggagctcgacgcgttcgtgctgttctcctccggcgccggtgtctggggcagcggcgggcaggccccgtacgcggcgggcaacgccttcctggacgggctggcggcccggcggcgggcacacgggctcgcggccacggcggtggcgtggggcggctggggcggcgggctcggcatgatcgacgccgacggcggcgaccagtggcgccgtatcggcatcctgccgatggatccggcgcccgcgctgcgtgcgctggcgcgggccgttgggggtggtctgccgaatgtgatcgtcgcggatgtcgactgggcgcggttcgtgccgggctacacgatggcccgggagcggccgctgctgcggcagttgcccgaggtcgccgagatcctggcggcggacacgcagggcgggggcgcatcgcggcgggaggtgctcctgggcagcctggccgagctgaccggcccggagcaggaggtgttccttaccgacctggtgcggcgtgaggcggcggccgtgctcgggcatgcggacggggacgcggtggagccggagcgtgcgttcaaggacaccgggttcgactcgctgaccgcggtggagctgcgcaaccggatcaacacggccaccggtctccagctctcccccacggtggtgttcgactatccgaagccgaccacgctggcgaggaggctgcgtacggagttggtccccacggtgaacggggacgtggacggggacgggaccgcggacggcggggccgccggcgcggacggccgcgagcgggagatccggcgggtgctggcttcggtgccactgcgccgcttccacgaactgggggtgctggacgcgctggtgcgcctcgcggactccgcggccggcgacctgagcggtctgcgcgacctgggcgacctgggcgacctgggcgacctgggcaccgccgcggaggcggagacctccgcgctcgcggagctggatgccgacgagctggtgagccgggcgatgcgcggcacgaccttcggaaacgactgacgccgcggttgcggagaggagtacacatggctgcgtcccgggaagacctggtcaaggcgctgcgtacctcgctgatggacgccgagcggctgaagcgggagaacgaccggctgatcgccgagtccaccgaaccggtggcgatcgtggcgatggcgtgccggctgccgggtggggtgaccgacccggagtcgctgtgggagctggtggacgaggggcgggacgcgatcgggccgttccccacggatcgcggctgggacctggagaccctgttcgactccgatccggacgccgtgggcaagtcctacgtacgcgaggcggggttcctggagggggcgggcggattcgacgccgccttcttcggcatctcgccgcgcgaggccctgtcgctggacccgcagcagcggctgctgctggagaccgcgtgggagaccttcgagcgggcggggatggatccgcggtcggtggagggccgggacatcgcggtgttcgccgggggcagcggccaggggtacggcggcggtccgggtgaggcgcccaagggcctggagggctatctgggggtcggcgcttccggcagtgtcatctccgggcgcgtgtcgtacacgctcgggctgaccggtcccgccgtgaccgtggacaccgcctgctcgtcctcgctggtggccgcccatctcgccgtgcaggcgctgcggtccggcgaatgttccatggcgctggccggtggtgtcgccgtgatgggccagcccaccgccttcgtcgagttctcccggcagcgtggcctggcgcccgacgggcgctgcaagtccttcggcgcgggcgccgacggcaccacctggtccgaaggtgtcgggctcgttctgctggagcggctgtcggacgcccgccgcaacggccacgaagtgctggccgtgatccggggcaccgcggtcaaccaggacggcgcctccaacggactcaccgcgcccaacggcccctcccaggagcgggtgatccgccaggccctgtccaacgccgggctgacggtggccgacgtggacgccgtcgaggcccacggcaccggcaccgccctcggcgaccccatcgaagcccaggccgttctcgccacctacggccaaagccgcccggagggccggccgctgtggctcggctccctcaagtccaacatcggccacgcgcaggccgcagcgggcatcgccagtgtcatcaagaccgtcatggccttacgccacggccggttgccgaagaccctccacgccgaacagcccacctcccaggtgaactggacgtcgggcgcggtgtccctgctcgccgaggcgcgggcgtggccggagaccggacacgcccgccgcgccgggatctcctccttcggcgtcagcgggacgaacgcacacgtcatcctggaacaggcccctgaggaagccgaggcgaccggggagaacaccgccgatcaggaaccgcccgtacgctcggcggagtccgccgaccccggcccggtcgccaccggccacgtggtgccgtggctgctctcgggccatacgcaggaggcgctgcgtgcccaggccgcccggctgctgacccaggtgcgcgagacgccctccgacagtccgcgggacgtgggctggtcactggccaccacccggacccggctggaccaccgcgcggtcgtactgtgcgccgatgccgagcaggccgtcgcggggctggaggcggtggcctcgggcacgtccgcccggtcggcggtcaccgggtccgtggcctccggaaaggtggcggtgctgttcaccgggcagggcagccagcgggccggaatgggccgcgaactgcacggcgcccacccggtgttcgcgcgggccttcgacgccgtgtgcgcccagttcggcgacctgcgcgacggggacgacaaggtctcgctggccgaggtgatcttcgccgaggaggggtcggcgacggcagcgctgctggaccggaccgagttcacccagcccgcgctgttcgcgctggaggtggcgctgttccggctcgtggagtcgtggggagtgcgccccgcgtatgtgctgggccactcgatcggcgaagtggcggcggcccatgtggccggggtcctgtccctgccggacgcctgcacattggtgcgggcgcgcgggcggctgatgcagcaactcaccgcgaccggggcgatggtcgcggtggaggcggccgaggacgaggtggcgccgctgctcgcggggaaggagcacaaggtctccatcgccgcggtcaacggcccggcctccgtggtcgtctccggtgacgaggacgtggtcacggcggtggcggagacgctggcgcggcagggccgcaagaccaagcggctcgtggtctcgcacgccttccactccccccacatggacgggatgctggacgcgttccgcgaggtggcgtcgcggctggcctacgcgccaccccggatacccgtggtgtcgaacctcaccggcgcggtcgccgatcccgaggagctgtgctcccccgagtactgggtacggcatgcacgtggcgcggtgcggttcctcgacggtgtccgcacactggccgacgagggcgtgcgcacccatctggaactcggcccggatggggtgctgaccgcgatggggcaggactgtctgcccgaggcggacgcggcgttcgtgccgtccctgcgtccgggcgtccaggagccgcacgcggtgctggccgggctcgccggcctgtacgtacggggtgtgcgggtggactgggacgcgatgttcgccgggtccggcgcccggcccgtcgcccttcccacgtacgccttccagcacgagcactactggctggagcgggccgccggctccggcgacgtgggcgcggtggggctcggcgaggcgggccatccgctgctgggcgcggtggtgcagctcccggagacgggcggggtgcagctcagcgggcggctgtcggtacgggcccagccctggctgggcgaacacgtcatctccggggcggtgctggtgcccggcaccgccatggtggaactggccgtccgcgccggggacgagaccggcaccccggtgctggaggagctggtgatcgggcagccgatggtgctgcccggcgacaccgccctcagtgtccaggtcgtcgtgggcgcggacgagggcgggcggcgtacggtgcggatctactcccgtaccgacgggggcaccgactggaccgagcacgccaccggcacgctcgcggcgcagggcccggcaccgctggacggggccgcgggcggggccgccgtcgagtggccgcccgcggaagccgagccgatccccgtggaggacttctaccgctcgctcgtcgacgccggatacgcgtacggaccggcgttccgcgggctcgtcgccgcgtggcgccgggacggtgagatcttcggcgatgtggcgctgccggaggcgtccgtcgcggaggccgagcggttcggcatccacccggcgctgctggacgccgcactgcacgcgggcagcttctgtctgccctccgacccggcgcgacaggtgaccctgctgccgttcgcctggaacaccgtgcgtctgcacgcgggcggcgcgtccgcggtccgggtgcatgtccgcccggtcggcgacgacgccttctcggtacgcctgaccgacggctcgggccagacggtggcctcggtggactcgctcaccttgcgggcggtggacccggcccagctcaagatcggcacggccgacgacgcgctgtggacggtccgctggagcgagacctcgctgccggacggcgcggtctcctgggccccgctcggcgagtcggccaccggggcaaccgggggctacggcgccacaggggacggcggaggcccagggggcgcgcttcccgacgtcctcgtggccgatacgcgcgcctgggccgaagacctcaccggaccgccgaccgcgcgggcccgggagctcaccggccgcctgctggaggagatccagcggtgggtcgccgacgacgccatggccgggacgcggctcgccgtggtcacccgcggcgcggtcgcggtccacgacgacaccgaggtcaccgacccggccgccaccgcgctctggggcctggtccgctcggcccaggccgaacacccggggcgggtggccctggtggatgccgacggagcgtgcgaggaactgcccgccggggtgtggtccggggacgagccccaactggcggtgcgcggtggcgccgtgtgggtgccacgcctcacccgggtcgagcccggcctgcgcgtgcccgcgcaggcgtcgtggcatctggactcggccgagtacggcaccctggacaatctggcgctgctgcccgacgaggccgagcccgcaccgccggcggccggtcaggtgcggatcgaggtccgcgccgccgggctcaacttccgggatgtcctggtggctctcggcatgtatccgggccggtcggtgatcggcacggagggcgccggtgtggtgaccgaagtcggtccgggcgtcacgggcctggccgtgggcgaccgggtgatgggcctgttctccggctcgttcggaccgctggccaccgccgacgcgcgcacggtgatccggatgccggagggctggtcgttcggcacggcggccggggtgccggtggcctatctgacggcgctgtacgcgttgcaggacctcgggagggtccagccgggcgagacggtcctggtgcacgccgccgcgggcggtgtgggcatggccgccgtccagctcgcacagcacttcggcgccaccgtcctgggcaccgcccacccctccaagcaccacgcactccaccggctgggcgttcccgccgaacggctcgcctccagccgcgacctcgcctacgccgacaccttccccaccgccgacgtcgtcctcaactccctcaccggcgagcacatcgacgcctccctcggacttctcaaccccggcggccggttcctggagatggggaagaccgacctgcgggagcccggcgaggtcggggcgcggcatccggaggtcacctaccgggcgttcgatctcggtggggaggcccccgcggagcgggtgcgggagttgctgcaccagttggtggagctgttcgaggcgggccggatcgagccgctgccggtacggcagtgggacatcacccgcgcccccgaggcgttccgctggatgagtcaggggcggcataccggcaagatcgtgctcaccctgccacgcgccctggacccggacggcaccgtcctggtcaccggtggcacgggcaccctcggcgccacgatcgcccgccaccttctcacccagcacggcgcacgccatctgctgctggtcagccgccggggaccggacgcacctggcgccacagacctgaccaccgaactcaccgaactcggcgccaccgtccgcatcaccgcctgcgacaccgccgaccgcgaccaactcgccgcgctcctcgccgacatccccgccgaccaccccctcaccgccgtggtccacacggccgggaccctcgacgacggtgtcctgaccgcgctcaccccggaccgcctcgacaccgtcttccgccccaaggtcgacgccgtcacccatctccacgacctcacccgcgaccacgacctggcggcgttcgtggtgtactcgtccgccgccggagtcctcggcgggcccggccagggcaactactccgccgccaacgcctatctggacggactcgcacagtggcggcgtgcgcacgggctccccgccacctcgctggcgtggggcatgtgggcgcagaccagtggcatgacggccgggctcggctccggcgatctgcaccgggtgcggcgtggcggcatcgtcgggctgtccacggcggaggccctggacctgttcgaccggtcggtggcgtccgggctgtccctgctggtgccgttgcggttggacatcgccgccctcggtgcggaggccgcggaaccgccgccgctgctgcggggtctggtccggccggcccggcgtacggcccggccggtgccgaaggccggtgagggcggcctcgccgaacggctggccgggctgtcggcggccgaacaggagcgtctgctcatcgagttgatccgcgaacaggccgcttcggtgctcgggttccccacggtcgacccgatcgggccggagcaggcgttccgcgacatggggttcgactcgctgaccgcggtggagctgcgcaaccgcctcaacacggccaccgggctacggctccccgcaacgctggtcttcgaccacccgagccccttggccaccgccgagttcctgcgggatcaactgggcgggcgcgcggtcgaggcggcgccccgcccggcccggcgtgaccggtcggctccggacggggccgaggatccggtcgtcgtggtcggcatgggctgccgcctgcccggcgacgtccgcagccccgaggacctgtggcggctgatcgccaccggaaccgacgcgatcgggccgttcccgcaggaccggggctgggacctggccgggctcttcgactccgacccggacgcacagggcaagtcctacgtacgcgagggcggtttcctcaccgacgcgggcggcttcgacgccacgttcttcggcatctccccacgcgaggccctgtcgatggacccgcaacagcgcgtcctgctggagaccgcgtgggagaccctggaacgctccgggatcgttcccacgtcactgcgcggacaggaggtcggggtcttcgtcggggccagtggccaggggtacggcaccggcccgggcgcggcgccggaaggcttggagggctatctcggggtcggcggtgcgacgagcgtggcatcgggccgggtgtcgtacaccttcggcctgaccggtccggcggtcacggtggacacggcgtgctcctcctcgctggtggccctccacctcgccgcgcaagccctgcgctccggcgaatgcacgatggcactcgccggcggcgtcgccgtcatgggccagcccggcgccttcgtcgagttctcgcgccagcgcggtctcgcgtccgacggccgctgcaagtccttcggcgagggcgccgacggcaccaactggtccgagggtgttggtctggtgctgctggaacggctctccgacgcccgccgcaacggccacgaggtgctggccgtgatccgtggcacggcggtgaaccaggacggcgcgagcaacggcctcaccgcgcccaacggaccctcccagcagcgagtgatacggcaggcgctggcgaacgccgggctgacggtggccgacgtggacgcggtcgaggcccacggcaccggcaccgccctcggcgaccccatcgaggcccaggcactcctggccacctacggccaggaccggccgggggacgaaccgctgtggctcggttcgctgaagtccaacatcgggcatgcccaagcggccgcaggcgtggccagcgtcatcaagatggtgctggcgatacggcagggcacgcttccgcggtccttgcacatcaacgaacccaccacccaggtggactggacgtccggtgcggtgtgcctgctcaccgatgcccgcccctggccggagaccggccacccccgccgtgccgggatctcctccttcggagtcagcggcaccaacgcccatctcatcctggagcaggcacctcagcccgagcccgagcccgcatcgaaggcggacgagggcacggacacccctgggctggtcaccaccggcggaaccaccccctgggtgctgtccgccaagaccccggcagctctgcgggctcaggcccgacgcctgctggaccatctggaatccgacatggacgcacacccagtggacatcggctggtcactcgccaccacccgcaccctccacgaccaccgcgccgtcgtcatcaccgacaccgaagccgatagcgacgaagccgcagctgctctcaccgccctcgcgaccggacaaccccacccccgcctcaccaccggccacgccaccacccacggcaaaacagtgttcgtgttccctggccaaggcgcccaatgggtgggcatgggagcccaactcctcaagacttcccccgtcttcgccgaacgtctccacgaatgcgccgcggccctggccccgtacaccgactggtcgctcatcgacgtcatcaccggcacgcccgacgctccctcgctcgagcgtgtcgacgtcgtacagcccgccaccttcgccgtcgtcgtctccctcgccgcactctggcaatccgtgggcatccaccccgacgccgtcatcggccactcccaaggcgaaatcgccgccgcctgcgtcgccggacacctcaccctcaccaacgccgccaaaatcgtcaccctccgcagccagaccatcgcccaccacctcgccggacacggcggcatgatgtccgtcctcacctcccgggaacaggtcgaggaagccctcaccccgtggcacggcaaactctggatcgccgcacacaacagccccaacgccaccgtcatcgcaggcgacaccgacgccctgcaccaactccacacccactacaccgaccagggcatcagggcccgcatcatccccgtcgactacgcctcccacaccggacacgtcgacaccatcaaaaaccaactccaccagaccctggccgacaccacgaccgagcccggcaccatcccctggctctccaccgtcaccggacagtggatcgaacccgacaccgtcgacagcggctactggtaccgcaacctccgccaaaccgtgcaattcgagcacaccatccacaccctcgccaacgacggctaccgcaccttcatcgaaatcagcccccaccccgtcctcaccaccgccatccaagaaaccctcgaagccaacgacacccccaacaccaccatcaccggcaccctccgccgcgacgacgacacccccacccgcttcctcacccacctcgccgaactgtccaccaggggaacaccaatggactggcccaccgcgtacaccggatcacaaccctcccaaatcccgctccccacctaccccttcgagcacgagacgttctggctggaccgcggcggtccgggcgacgtccgtgccgtggggctggaggacaccggccatccgctggtcggggccgtggtgagcgtgcccgacaccggaggtgtgctgctcaccggacgtctctccctgcgcagccacccctggctggccgaccacgccgtctccggcaccgtcctgctcccgggtacggcgatggtcgagctggcggtgcgcgccggggacgaggcggacacctccaccctggaagagctggtcatcagccggccgatgacggtgccggacgagggcactctgcacgtccaggtgctcgtcggtggcgaggaccgcgggcgccgcaaggtgggggtctactcgcgcccggagggcacacggcagtggaccgagcacgccaccggcaccctgaccggacgggctaccggcaccctgaccgcaggggccacggccccgccgcccgaggccgctcagccgtggccgcccgagggctcggagcccgtcgccctcgagggattctacgagcatctggccgaggtcgggtacgagtacggcccggctttccgcggtctgagggcggtgtggaagcgggacgacgaggtgttcgccgaagtgtccgtgccggaggagcagaccggggtcgccgggcggttcggcatccacccggcgctgctggacgccaccctgcacgccgggaacttctgcttccagtccgatggtgagcggcccacgatgctgccgttcgcatggaccgatgtgcggctccacgccgtgggcgcaaccaccgtgcgggtgcgggcgacggtgtccgacggggacgggctgtgcgtacggatctccgatccgcagggcgtaccggtcgccacgatcggctccctccagctccgggagaccacacccgaccagttgcgcgccctgtccgccgcatcgggcggcaatgcgctgtgggcggtcgactgggccgagtgcgggctcgatgccacggaagcgcggtgggccacgctcggggagagtcggctcccggattccccgccgagctaccccgatctctccacggctgtggaggccgtggaaagcgcggaggccggagagcggcccgccgtgctcgtcgccgacgtgtccgcctgggttccggagaagaccggacccatcgaccgtacgcacgcgctctgtgcccgggtcctggatctgctgcggcaatgggtggaccggcgcgaactcgcggacacccacctggtcgtcctcacccacggcgccatggccgcccacgacaccgccgaggtcaccgacccggccgcggccgccgtctggggcttggtccgctcggcccagtccgagcaccccggccgtatccggctcatcgacatcgacgaccactcccaccaggccctgcccaccgcactcgccaccaccgaggcccaactcgccctccgcgacgccaccgcctacaccccccatctgacgcccgcacccgccaccacgcccgagcccctcaccctcgaccccgagggcaccgtcctcatcaccggcggcaccggcaccctcggcgccctcaccgcccgccacctcatcacccaccatcacgcacgccatctcctcctggtcagccgccagggccccgacgcgcccggcgccacggacctcaccaccgaactcaccgaactcggcgccaccgtccacatcaccgcctgcgacaccgccgaccgcgaccaactcgccgccctcctcgccgacatcccggccgcccaccccctcaccgccgtcgtccacaccgccggaaccctcgacgacgccctgctcaccgacctcaccccgcagcgcctcgacaccgtcttccgccccaaggtcgacgccctcacccacctccacgacctcacccgcgaccacgacctgaccgccttcgtcatctactcctccgccaccggcaccctcggcacccccggccaggccaactacgccgccgccaacacctacgccgacgccctcgcccaccagcgccacgccaccggactccccgccacctccctcgcctggggcctatgggaaaccaccagcagcctcaccgccggcatgaccgccacccagcagcaacgcacccgcgacagcggcgtcgttcccctgaccgacgccgacggcatgcgcctcctcgacaccgcgctcgccacccgccaccctcatctcgtccccctcgaactcgacctcgccgccctccagaacaacaccggcccgcacaccctcccgcccctgctgcgcaccctcatacgcggccaccaccgccccaccgcccacaccacagcccagcccgaggacgacgccccgtccctggccgagcagctggccgccctcgacccgacccagcggcaccagcgcctcaccgcgcttgtccgcgccgaagccgcggccgtcctcggacaccccaccccggacgcggtggggccggacgacgccctcttcgagatcgggttcgactcgctgaccgcggtggaactgcgcaaccgcctcaacgcggccaccggcctccagctcgccgcggcgatgctgttcgactacccaaccccgtcgatggccgccgagcacctccaggaacagctcgcgctggacgcggccaccacggaaacacacgtggcggcccgggaagcggcggaagacgacgaccagagcacggagaggtgagacaaagcatgttcgacgtggcgaagtatctgcggcgcatcggggtggaggggacgcccccaccgaccctcgacaccctccgtcatctgcacaaacggcatctcatggcggtcccgtacgacaactccacagcccccgaccggctcccggcctcgcggcatctgacgaacgtcccgctggacctggtgttcgggcatgtggtgaccgagggccatggcggagtgtgctacgagctcaaccggttgttccacacgctgctggcggagctcggctacgacgtgcgcatggtggcggcggcggtgcggcaggcgaacgggaccttcggcccggagcgggagcacaccttcgacctggtccacctcgatggccggacccacctcgtggacgtgggcttccccgggccgtcctattcggagccgttgtacctgtccgaagaagagcagcaccagtacggctgctcgtaccgcgtgaccgaacacgacggctaccgggtggtggaacggcggcccaaggggagcgactggcagccggtgtaccggttccggccggagctggccgatccgtccggctgggacgcggtgcggctggacagcctggacgactacgcacaggactcggtgctcgccgggaccaccttccgcagccgggccacggacaacgggaagatcgtgctgatcggcaggcgctacttcaccgtcgaggacggggtggagcgcaccaaggtgctggtgaaggcggacgaattccaagacgtggtcgacctgatcctggcgggcgcatgaccgggaaggaggcggcagtggacaccgcgcgggaaacggacagcctcgaggccgaggtgctgatcgtcggctacggaccggtgggccagctactgtcggtgctactggcccagcgcgggcggcgcgtgacggtcgtggagcgctggccggagccgtaccggcacccccgggcggtcgggttcgacagtgaggccgcgcgccttctggcctcggccgggatcggcgactcgctcgacaagttcaccgaacccgcgcgggaccacgcctggcagaacacgaagggcgagacgctgatcgaccacgaggtggccgaccgggggcactgcacctggccggaggctttgtcggcgtatcagcccgccctggagtccgcgctgatcgagcacggggagacgctgccgccgctgcggatcctgcgcggatacgaggcggtgggactcgcggacgacggcgaccatgtgaccttgaccgtggtcggcccggacggggagaagacggacctcaccgcgctgtgggtggtcggctgcgacggcgcgaacagcctggtaaggacgggcgtcggcaccaccatgacggacctcgacttctcgtacgactggctgatctgcgatgtgcggttgcacgagcaccgcgagttccggccgaacaacctggagatctgcgatccggcgcgcccccggacggcggtgtccgcgggtcctggccaccggcggtacgagttcatgcgggtgcccgcggacgaccccgaacacttcggcaccgtggagagcgcctgggagctgctgcggctgttcgatgtgacgcccgagaacggcgttctggaccggcacgcggtctacaccttccaggcccgctgggcggagcgctggcggaccggacggatggtgctggccggggactcggcacacctcatgccgccgttcgcggggcagggcatgtgctccggattccgtgacgcggccaatctggcctggaaactggacctggtcctgggcggacacgcggcgccgacgctgctggacacctacaccaccgagcggcgggcacacgtgcggcacgcggtggagatgtcggtgggcctgggccgggtggtgtgcatggcggacccggccgcggcggcggaccgtgacgcggcgatgctggccgcgcgcaaacgcaacatcggcccgagtgccgcccgccgttccgtggtgaggccgctcgtggacgggctgctacggcaggacggtcagggccgcccggcaccgtacgccggccaggcgggcccccagtggcgagtgtgccgcgcgggaaccaccggcctgttcgacgacgtggtgggcaccggtttcgtcctcctctacgccgaggacgtgttccccgcgctggacgcgcggcggctgacattcctcgacagcatcggcacccgactggtgcgcatggtccccgcggacacgcccccggccgccctggggccacgggacgcgctggacgtggaggaccggtacctgtcctatctgtcggagatggacgcgctggcggtactggtacgcccggacttctacctgttcggcatcgcggaggacgagggcgaactcctctctctcgtagacgacttggccacccagctgagcccgtcacccactccttcgtaaggctcccctgcctgggcatggctggtcccttcccccaagttccctgagggaagggaccagttgctttcacggccctgcggccgtcgaagcctcaaggagccccgcgcggcttccggcatgcggcgcacggcctccgggctgatggcgccggccgccgtacgagcgctgcggaggctcgtcgacgagatggaggcgcttcaggtcgaccgggcgcgtgaactcggctggtcctggggcgacatcgccgggtcgctcggcgtttcgcggcagctcggcgcaccagaagcacacgcggtggcgtgcgaagaccccgcatccggcttcgcggccgggggcggggtctgatggcacctcgggtgaggcgccagcaaggggcgcggggctgtgtcgatgtgcggctccgccgggtgggcgcgaccagccacgacggcgccgcggaagatcgacggcaggtcaggtcatatccaccggagcgattaggtgtccgaagtgacgctctcccccgtccccgccgcgcggcggcgttcgtcgcccgccttgaccagggcgtatctgatggccagggccgccgcgttgaccgcgtgcaacgcttcctgcgcgccggtgtcagggtgtatctggccggtgacggcggccgaggtgcactgggcggcctccaggcaggcgacgcacgcctccacgagggcgtccgggcgtgtgccggaggatcggcccagtttcgtcagcagccgggtgatatcccggtgcgcttcggtgatcgggtccgccgccatcgggtcagtgcccccgcgtaccgtcgtcggccaacggccctatgtccccggccggggccagggtgaggaaccgctgctcccacagggcgaacacctcggtggccagtgcgtccgacagcccgcccacggtcttggccagatccccgagggtggtggtgccgtcgaccgcgccgagcagttcgtacagctcgggcgacaccttcgcggacgggccgccgtcgtagtcgaggtggatctcgtgggtcttggctcccgccgaggcgtccggaccggccgtcctgcgctcgaccagccgggtcaccgggcggaaccgcggcaccagaacgcccaggtcgggcgaggctttgccgcgtaccaggcagtcctccaccaccagaacgtccaggtcggtggtcaggaagctggtgaccacgtcgtcgaggctctgcacgatgggttcggcgttgttgttgaaggaggtgttgaggagcacgggggtgccggtcagttcgccgaatcgccgcaccaggcggtggaaccgctcgccggactcggcggagacgacctgtacccgggcggtgccgtccacgtgggtgaccgcgccgagttccgtacgccgctccggcagcaccggcaccacgaaggacatgaactcgtggttgccatccgcgccggagaggtcgaagtagtcgcgggcggcttcggcggtgaccaccggggcgaacggccggaagccctcgcgcttcttcaccatcgcgttgatgcgggtccggttctcctcggggcgtgcgtccgcgacgatgctgcggtggcccagggcgcgggggccgaactcggagcggccgtacgcccagccgagcacctgtccctcggcgaggagtccggccgcggtctccacggcgtcgtccgggaactccacatcgatcagcggcgcccagtcggccaaccgtgccctgatctgctcccggccgcccagtgccgggccgaggctcgcgctgagcagccgcttccccgggcgctccagcgtgccaaggctcgccgccgcggcgtaggcggcgccctcgcccgcgcccgcgtcgtgcgaggcggggtgcacgaacacctcgtcgaagagtccggacttgaggatcagcccgttgaggctggagttgtgggcgacgccaccgccgaagcacaggcgggagtggccgctggtcttcgcccagtattcgaggatgtgcagcacgatcttctcgaccgtctcctggagcgcggcggcgaagtcgcggtgcgcttgggtgaacggctcgcccttgcggcgcggccggaagccctcggcgtagaacagcgggctgaccaggttcggcaccatgatgttgccgtgcagctcgtactcgccgttgtcctggagggtgtagagcttggcgaaggtgtcgcggtaggtctccgggttgccccagggggccagacccatcaccttgtactcgtcgccgaagccgtagccgagcagataggtggcgttcaggtagagcccgccgagcgacttgggcaccgggtagtcggccagcttctccagccgcgtgccctcggcgcggtagacggtgccggagtgcagttcgccacggccgtccagcaccaggaccagtgcggagtccatgccggagtgcagatacgaggagtacgcgtgcgcctcgtggtgcggcacgtacaccagcttctcgtccggcaggtcccagcccaggccctccttcagccgctgccggatcagctcccgggagtagcgcaggggcgccctcggatattcggtgtagaggtggttgaggacggtgtcgatgtggttctcgggaaagtagtagcccaccgcgtcgacgtcctcgggccgcgcaccggccagggccaggcactcacggaccgcgttgaggggaaatttggttgtcttcttgatccggttgagccgctcctcctccacggcggccacgagttcgccgtcgcggatcaaggaagccgccgagtcatgaaagaacacctctccgagctgcggcaccacatcggtgtccgcggcggagaagttgccgttgagcccgagcacaagcacagtgatcacccaaaccagtcggaggcgaacgcgaggatgcggggcggaagacgcccgccggtcaccgggagcgcggcagcgccgcgtcggcgagctcaggcgccgtcagccgcagcgtcgtcggagccggctggcacgcgggggtgaggtggaggcgttcgaccccctcctcgtcggggaccgcgagggcgacggtgcaggcgcaggtggtgtcggcgaacccggcgaagcggtaggcgacctccatcatccggttgcgatcggtgcgccggaagtcggcggccaggtgcaccccggcctgcgccgcctgatcggccagccagctcagcagggtggacccggcgccgtaggagaccacgcggcacgaggtggccagcagtttcagatgccacaccgcggggtgccgttccagcagcacgatgccgacggccccgtgcggaccgaaccggtcggccatcgtgatgaccagcacctcgtgtgcggggtcggtgagcagtccgcgcagtgcggagtcggggtaatgcacaccggtggcgttcatctggctggtgcgcagggtcagttcctcgacccgggacagctcccgctccgtggcgcgggagatgcccatgcgtatgtccagggtgcgcagaaagtcctcgtcggggccgctgaactcggcccgctcggcgtcacggcggaacccggactggtacatgttccggcgctgccgcgagtccacggtgaccacggcggggctgaactcgggcagccgggtgagcccggccaggtcctcggccgcgtagcagcgcacttcggggagccggtaggtgacctcggcccgttcggcgggctggtcgtcgacgaacgccatggcgcggtcggcgaagttcagccgatcggcgatggcgcgcagcgatgcggacttggggccccagccgatgtgcggcagtacgaagtactcggccaggcccagcgcttccaggcgctcccaggcgtggtcgtggtcgttcttgctggcgatcgactggagaatgccgcgttcgtcgagggtggtgatgacatcgcgcacccactcgaacggcagcacctcgccgtcttcgagcagggtgccgcgccacagtgtgttgtccaggtcccagacgagacatttgacggccgtcggcggctcgctcacgggcttcccctccgtcatgcttgcaccttcttccgcgtgtgctgggcgaggacgagctggcagatctcgctggtgccctcgatgacttccatcagcttcgcgtcgcggtaggcccgggccaccacatggccgtcggatgccgcggccgacgccaggagctgtacggcgcgtgccgcgccctcggcggcctcgcgggacgcgacgtacttggcgtgcaccgcgtcgaccgccatgtcgggcgagccggtgtcccaggaggcgctggcgtgttcgcaggcccgggtggcgtgccgctccgcgacgtacagttcggccaggtgccgggccaccagctggtgctcggcgagtttgcggccggactgttcccggctggcggtgtgcgtggcggcggcgtccaggcaggcgcgcaggatgccgacgcacccccacgccacggacatgcgcccgtaggtgagcgccgcggtggtcgccaggggcagcggcagtccggtgccaccgagtacgtggccggcgggtacccggaccgcgtccagggtgatgtccgcgtggccggcggcgcggcagcccagcgggtccggcacccgcgtgatgcggacgccgggggcctgggcgggcacgaccacggccgcggcgccgccgcggtacttcccgaacaccaccagcaggtcggcgtagtgggcggcggtgatccacaccttgcgcccggtgacgaccacgtgtgtgccgtcgtcggcgatctcggtctccatcgccgccaggtcgctgcccgccccgggctcgctgaatccgaccgccgccaggtcaccggaggtcagccggggcagaaaggtgccccactgctccgcaccgcccagccgccgtacggtccatgccgccatgccctgggacgtcatcacgctgcgcagcgagctgcaccgggcgccgaccgccgcggtgagctccccgttggcatggctgtccagtccggtgccgccgtgctcggcgccgacctgcgcgcacagcacaccggaggcgccgagtttgaccaggaggtcgcggggcagctccccggccaggtcccaggcgtccgcccggtccccgatcaacccgctgaccagctccgtatggctggtggcggcgtcggtcacggctgtgccccgcgcagccgcaggaccatcgtggtcatcgcgttgaccgtgcggaagttgtccagcgccaggtcggggccggtgatcaccacgtcgaaggtcgactccaggtgcacgaccagctccatggcgaacatcgaggacacggcgccggtgccgaacaggtcggtgtccgggtcccaggtctgcttggtgcgctgttcgaggaactgctgcacctcctgcgccaccgtctcggcggtgtggctgcccggctcggatgagatggtcacgccagttccttcccgtatgcgtagaacccgcggcccgacttgcggcccaggtggccgtcgcggaccttcttcagcagcagttcgcacggcgcgcaccgggcgtcgccggtacgtagctgcagcacgcgcagcgagtcggcgaggttgtccaggccgatcaggtccgcggtgcgcagcggcccggtgcggtggcccaggcagtcccgcatgagtacgtccacggcctccaccgtcgccgtgccctcctgcaccacccggatcgcgtcgttgatcatcgggtgcagcacccggctggtgacgaaccccggcccgtcgccgacgacgaccggcttgcgctccagcgcacgcagcagatccgtcacggcggtcatcaccgcttccccggtacgggggccgcggatcacctccaccgtcgggatcagatagggcgggttcatgaagtgggtgccgaccagccgtgccggatcggcgatatgaccggccagttcgtcgatcgggatggaggaggtgttcgagatcagcggcacccgcgctccggtgagcccggcgaccgcttcgagcaccttggccttggtgggggtgtcctcggtgacggcctccaccacggcggtggcgttccggccgtcggccagggacgcggtgaccgtcagctcgccctgcgggcgaccggccggcagggctcccatgagctgcgccatgcggagccgttcggtgaccgcggcccgtgttcggccggccttggcctcgtccacctcgacgaccgtcaccgggattccgtgcccgacgacgagagaggtgattcccagtcccatcgttcctgcgcccagcaccgtgagccgcggcgcttccgcatctccgctcatcaatcgcctccgcagcgcgttgtgaacaacgtgccgaccatgacacgcgcttccgcgttcacggtattctccgggcggtcacccaaatcccctaaggatcccccctatacccccctcagccggaatatgagttccagcattctggaagacgccattgcgcggcgcatcgacggattcttagcatgggccgcattgcctttccctgaaccttcccttttcagctttgcggggtgcggaaatccaatggctcagcaagtcgatgtgaccgaagaaattctcggatatgtccgggaactgtccctgcgcgatgacgagattctggccgggctgcgggcacagaccgcgggtctgcccgccgcgcaggccatgcaggtgatgcccgaggagggccagctcctcgggctgctggtcaggctcgtcggcgcccgttcggtgttggagatcggcaccttcaccggatacagcacgctgtgcatggcgcgggccctgccggccgacggcacgctggtgacctgcgacatcacggcgaagtggccggggctcggccgcccgttctgggagcgcgccgacgtggcggaccgcatcgacgtgcgcatcggcgacgccaaggagacactggccggactgcggcgggagggccgggagttcgacctggtcttcatcgacgcggacaagaccggatacgcgcactattacgaggagtcgctggcgatgctgcggcgtggcgggctcatcgtcctggacaacaccctcttcttcggccgggtgaccgacccagccgcgcaggacgccgacaccgccgccctgcgcgaggtgaacaagctgctccgggaggatggccgcgtcgagatcagcatgctcaccgtgggggacggcatcacgctcgcggtcaaacgctgagtccgcggctgagcgtctgcgcggctgagcgtctgaacgtctgaacgtctgacggccatgttccgggggtctcccgggacatggccgtccgcgcggctccgctgtcaggcgcgccgcgccgcggtcacgccaactccggccggtcgacgtacagttcggtgggcagttgctcccggtgcttgatgtccagcttgcggaacacccgggtcagatgctgctccaccgtgctggccgtgacgtacagcttcccggcgatctcccggttggtgtagcccatcgcggccagcgacgcgacacgccgttcggagtgcgtcagccgctcgatcgcggtgtccgacttcggcgttggtgcggtggcatggtgctggtcgtcggccggcagccactcctcgtacagcgacgccgcgtcgcacatcttcgccacatgccaggcccggcgcatggtccggcgggcctgcttcttctcaccgagcgcgtggtacgcctggctgaggtcccacagcgtgcgggccagctcgtacttgtcctcctgctcggtgaacaggcccaccgcctcgttgagcaactgcggccgccgcttcgccgaactggtggccgccagaagacgcaacgactgcccgcgggcccgggcgccgtccgtgtgcggacggctgagctgctggtacaccaggatccgggcctggtcgtggttgccctgcgccagccatgcctccgccgccccgatccgccacggcaccgggtcgcagccgctgctcagcccccagtcggtgagcagttcaccgcacagcaggaagtccgcgagcgcggcctggtgccggccggccgccaggaagtagtggccgcgcgcgtacaggtagtgcagcccgtaggagcttttgaacatggcgttgggcacggtctgcgcgacatggaaccccgcctcctcgtgccgccccatccgcgtacacgccaggatgagggcgccgagcggcagcccgatcgcgacaccccaggcgccgggggaggcgtgggtgagggcggcgcgggactgctccgcggcctcggcgaggtcaccgcggcgcagtgcgatctcggacctggccgccgacagcaccgcctgccgcatcgggacgtgcggtcccccaccggtctcgccgagcgcaccctcgcaccaggcggacgccaggtcgttccggccgccgtagaccagggcgagcagggcgaacagccccgcctgctcgtggcatgccgggtcgtgcccgagctgcagttcgcgcagcacctcctcggcccgccggacggtgtcatgggtctgcccgccggtgagcacgtcggccaggacggtgccggcccggggccacaccgccgcccgtgtcgccgcggagccaccgtggtgtgccggggccgcccgccgctccgccagccagggataggtgcaggtgagtgccgcctcgatggcatggagctggtccgtggccgcggggtcctcgcgcaggtgggcgagcagcccctccacctcgctcagtccccccttccacaggagctgcatgagcagggtgacgctgtcggggaggccgagccggccggcgcggacggcggcgtacagcggtgcgtggtgccgcgtggcggtggacggattgatcttccattccgccccggcgagcttcgcctgcagggctgcacggcgctcttcgtgcgggcattgctcgaaggactgctccagtaagtcgacggcgatggacgcctcttcgcccaccgccacctgctcggccacttccagaagcacctcggccgaccacgagtcggggatctgcccggcccgcaccagatgacgggcgatcgcggtggcgggcctgccctggtcgtgcagcagccgcgcggcccgctggtgcagggtcctgcgggcctgtgccggcatgtcgttgagcacgctcaaccgcgccgcctcctgccggaactcgccctcgtccatcagtccggccccggtcagcgccgcgagcacctggctgatgggctcgggctcgtgtccggtcatccaggcgaggtcggcggcgggcagggcggatcccaccacggccagtgcgcgcaccacgtccaggaagatcggctcattgcggtgcaggcagctcaggaaggactggccgtagccggcctggctggcctcgccgtgttcgcgatagtcggacagcagagtgtgcagcagcagccggttgccaccggtggcggcgcagatgtcgccgacgtggcggcgcgcggtctcccccagctccgccacgaccacttcggccacctggccgggggagagcgggcccaggccgatgcggcgcaggtgctgggcgcgcagcagttcgtagcggagcggcagggacgacggcaggctcaagtcgtcggtgaatacggccgcgatgcgcgccgagtccaggcgccgcaccagttgcaggaggaagtgtgcggaggccgcgtcgctgtgccggacatcgtccacggcgacgagcagcggcgtgtgttccgcgtggtcgatcagcgaggtgcacagccggtggcacagccgggcgatcccggcctggtccagcggatcgccggccgcgcggaggatgtccggcagccccggtacctcgggcagcccgcccggtgatttccaggcgccgcgggccaattgtgagacgaccccgaagggaaggtcccgctcgctgggggaacacgtcgctgtgacggtgagatagccggcctcggaggctcgctcggcgaacgaccggagcagggtcgtcttcccgcatgccagcggtccgtccacgagaagagcctgcccgggccgcaccaaagagtcaccgaatggatgtccgaggtacgccgcggtatgcaataccccgcccatcggacgggaattcgactcggtattcaacggcatggcatagctgtagggcatggtgatggtccccgatcgaggtcgacggaatacggactcgcggcccttgagtcagaccaaattgttgatcgggacacgattccatcagcacgcccccgcccgcctcaacccctaccggaacctccgccccctaaccggcgccaccacatctcgttctcttcatcgcgccgtcagttatccgtggcgggcgccgcacggtcaaccccctatcgagtccgtgcgcccctaaaacgtatgcggagaaacgtccaggcggctcggataccgtgacgcgtcaccatgcgggcgcgcggggcatcgccgcgagggtggcgccgacggtgtcctcggcgatcccgcgcaccagtccgggccccgcggggctatccaggacgaacgtcagcccgtcggtggccttcttgtccaggcgcatcagctccaccagctcggacacggagacatgcgggggcagcgcggtcggcaggccgtagcgggcgaccacgtcatgatgctcggccacgcgctccgggccgatgcgccccagcgcgccggcgagccggccggcgaaaaccgtgccgatggccactccctccccgtgccgcagcgcgaacccggtggcacgttccagcgcatgccccaacgtgtgtccgtagttgaggaggtggcgcaggcccgagtcgcgctcgtccgcggcgacgatgcccgccttgagcgtcacactggccgagatctggtcgagcagcggcagcccgtcgagatcgggcgcgccgatgaagtggcagcgggcgatctcaccgaggccgttgcgccattcccgttcgggcagggtcttcagatgttcgaggtcgcagagcacggccgcgggctgccagtaggcgccgaccagattcttgccctcgggcagattcaccgcggtcttcccgccgacgctcgcgtccacctgggcgagcagcgaggtcggcacgtgtacgaccggggtgccccggtggtagagggcggcggccaggcccaccgtgtcggtcgtggtgccgccgccacaggacaccaccacatccgagcgggtcagtccgaatccgacgaaccggcggcacagatcggtcacggcggccaggtccttggccgcctccccgtcgcgggcgggtacgacgagcgagggcactcctgggtcgggggtctgctcggcgggccgcgcggtgaccaccaccgccctgcgcgcgcccagggcggccaccacctgtgggagcagccgctgcacaccgtgtccgatgtgcacggtgtaggagcgttcggccagcccgacgacgacctgtcgggcgggggaagcggaactggcggccggactggaagtcgacgtggtcaagactgctttcccatcgctggcgcggccccggcgagaagccgtctcgccggggccggaatcgggtgcgtgcggagcccttttcagtcctcgaccgcgatcgcggcggccgggcacaggaacgaggcctcggcgacgctgtcgcgcagcgcgagcggcggccgcgggtccagcaggaccactgtcccgtcctcctcccgctggtcgaaaacctccggcgccgccagcgcgcaatgcccggccgcgcagcacttctcctgatccaccgagaccttcaccatcgtgttcccctcatcatccttctgtcatccgttccgcggtcaccaggcgacgggcacacgggcgacgccgaagttcatcgactcgtacaaaaacgccaggtcgtcgaacgggacctccaggcggagcgtcggcagccggcgcagcagggtctccagggcgatctggagctcgacccgggcgagggtctgccccaggcactggtgcactccaaagccgaacgcgacatgttcgcgggcgttcggccggctcaggtccagttcgtgggcgtccgcgaagtgggggtcgcggttggcgctgggcagattgatgatcaccccttcaccgcccgggatgagcaccccgccgacctcgacgtcctcggtggccacccgtcccgtgccttcctggacgatcgtgatgtaccggagcagttcgtccaccgcgttgcccatcagcccggcgtccgcccgcagccgggcgagctgttcggggtggctcagcaacaggacggtggacagggcgatcatgttggcggtggtctcgtgcccggccagcagcagcaccagggcggtggcgaccacctgctgctgggtgagcccgcccgtcagctcctggtcgacgatgagccggctgaggagatcgtctcccgggtcggcgcgcttggccgcgcacatccgggcgacgtagtccaccatgacgccgagcgcggcgcccatctcctcggccgacgcggtgaagtccatgacgccctgcgacgcctgctggaactccgcgaagtcggcgtccgagacccccagcatcacaccgatcacctgggacggcagggggaaggcgaagtcggccaccaggtcggccggcggcccctgggcgatcagccggtccaggaggccgtccacgatgccctggatcatcggccgcatcgcctcggtgcgccggatggtgaagttcgcggtgagcatgcggcggatccgggcgtgctccggatcgtccatcctcccgaggttgaacacctcggccggcacctcgaacttcacgaagcgcggcatcgccttgtgcgtgccgtcggcgctgaacctgctgtcgccgagcgcggcccgcgcctcgtgatagccggtgacgagaaacggggtgctgccatcccacatccgcacccgcgtgacggcggaccgctcgcgcaactcctcgtatcccagcgggggtgagaacgggcatgcagcagcccgcgattcggggtagtcgcgtatctcgtccatgcctgtccgtcctgtccgtcgcttcgtcgccaccactgcgccgccctacggatggacaagtctggtccgcgcacccgctccccactcccctaaccactcccctatgcccccttggcttgagggcaggtatccccccttgcctcggcggcaggacactcagcaggaggacgatccggtggctccgatgagcagccacagacgacgcgacagctcctgccgatttcccacggagagcttgcggtagatgcgcgtcagatgctgctccacggtgctgaccgtgatgtagaggctcttggcgatctgccggttggacatccccgacgcggccagggtcgccacgcgccactcggcctccgagataacgggctgctctgcgccttcggccgatgcgccgggctctctctcctcggactccccggcggcttccgacagtcgagcgtccacggagctctcggcgccgtccacgaccaggtccctgcggctctcgtgctgggcgctgatcccgcactcgtccatcagcttctgcgcctcatgccaggtggtgcgagcctgttgggtctctccggtgctgaggaagtcctggctgagctcggcgagcgtacgggcgagttcgaaacggtcgccgtgctcgcgcagacacttggcggactgatagaggagcagcctgcgcttgtccgggtcctcggccatggccagaacgcgcagcgctcggccacgggtgctcaaggggcggtcgggcgagagcttgagctcttccagggcgagtcttttggcctccgccggctcctggacatgcagatacgcctcggcggcgtcgatgcgccagggcgccaggtcgccgaagtccacgggccactggtccatcagcatcccgctcaccatgaaatcgctcagcgcggcataggagcggttggtggccagacagtactgtccgcgagcccggaggtactccaatcccacaacgctgtcgaacatttccttcggcacccagtaacgcagatatcgctcggcctcatcgagtctgccgatggcggtgtgggccgccaccagaacggagagcggcaatccgatggcgacgccccatccgcgcggggggatggaattcagtgcggtgccggcgaaatcgatggccgaggtgaagtccccacggcggcatctgatgtaggcgcgcatggacagggcgacggcgccgggcgtcttcatgttcagcttgtcggccgcggtgaaaagcgcgccgcacagccggtccgccgtttccgcttctcctctcgcggctaatgcccagaccatccggcaggcgtatgcgtacgcgaaccagaagtgattggagggcgacaacagatgcatggcatcgggagagaagtccgccacctgccggggatcctggaaatgcccgatctccatgcccagttcgccgacggacagctgcagaccgtgctccaggttggccgcccacagcccgtcgacttccccgtccgagagaggctggtcggggaagtcatggatcagggtcggtttaaggaaggtggcccactgccgggtcacccgcagagcggccatgctggacgcgttatcggtgtcaccaccgcccgacagccacttgaaggcttcttccccatcgctgaaccggccgaaccacagcaccatgaagagcaggaagcacagataccgctcggggatgtcggcggggaattcctcccgtatcgcggccaacaggcggtccagttcgggttcggcggtcgccggattgctggaccataacgccccgaccagcgccatgagaatgtccatgtgctcccgccggccgaggtccgcgcgggcggcgagccgcaggccggcgatcgcttcctccgtacggccgtggtcgagattcttctgggccgcgtgccagagcactgtgacgcctttttggtcgggcgttttatcggcggtgaccagaagttccgccaccgcgatcgggtcggccccgtcggcatacagaagttcggccgctttcgcgctgaggcgggcccggtcctccgcgggcagcgtctccagcgtggcgtatcgcgccgcggggtgccggaaacgtccgtcctccagcagtcccgcggagttcatgatggtgatggcccgggccgcgcgttcctggccgcattcgagcagattggccacccgccacgggctgccgtaccggtccagcaccgcgagggcctgtgccacctggagcaacgccggatgggataacagacacccgcgataggcctcctggaactccgcaccgacagtgacagcagtctccggcccgcccggagcggcttggagatggtcgcgcagcagggccttgaccagtctgggattgccaccgctgacggcgtggcaggaggcgcggatccggtcggccaggtcggcgtcgctgtgccgctccagcaggtatccgaccccggattccgggagtgtatcgatcttgatcttgtagaactcgtggaagccgtgagtcggggcgcacaacggatgtgtctgcccgccggtcatcacgacgagtgtgcgagtgccggacgcatgcctggcgatatacagaaggcacatgagggaggggtagtcggcatgctcggcatcgtcaatcgcgatgatcagctgcttgccgcccgcgatacggtgcagcacatcggatatttcacggaccaggcttctcagcatgccgggttcggcctccgaataccgctctccggcagtcctccagcgcgccacgacgtccaattcgcccatgaacgcggaggaccagatcagccgttccactatgttgaacgggatggcggtgtcgtccgcgaatccggacgccgtaagacagaccgcacccgactcggccgcctgttccttcagacagcccaataaggaggtctttccgacaccgggccccccggtcacttggagaagcccgccgttgcctcgtgctgccgcgtcgaggacgtcgcgaagctcgaattgataatctgtcagtcccatactcatcagtcctcgctgtgggggtgtgcgtctgagcgatgagttgatctccgcagtcatcccaccctgcggaagaaggcttctctgacgagacagataaccgctgcgccgacggcggccgattccctgatctggatcacctccggtgggagcccatgtccttgacgttcatacaagcagagtcacaaccggagcgaaaccttccaccgatcatgatgaaccacggtttccgacccccgtgtgaacgtgcctgcccgagcgggcggcccccttcctcgcacccccgagaagggcggggcgccaccggtgccgacgcgcaggagaaatgcgatgtgcggcatgccgacgcgaatgcacctcggactctgaaccggttatggacccggcagcattccttgccctgtgcaaagctggcggtttaccagcagccgccccggccggtcgccgctccacgcccgtcccagcgggctccggagcggcaagtgccccacctgcggtcatcccccggttgcctcaaagtcatgtcgcgtaccattcccggcaacctcctcgcccctcagcagatatgtctgcccccgactcgcgacggagatacggggattgacccctatatgatcaccgcgacagcgcgaccataaacggccgccgccccatgattcccctaaactcttcgccgtgatttggccgggatttatctgcctgcaaaacggccgaaacgggtgcgccgtggaccgagcccggggccggacccgcggcatacgacgccggaagtcctggctcctggccacttcagagacgagggagcgtgaactgtgaccgtcaagggcgcgttgttcgacttctccgggacgctgttccgaatcgagtccgccgagtcctggctccgcaccgtgctggagcggagcgggaccgcggtcccggacgaggatgtcctacggtacgcgcggaacctggaggaggccggtgcgctgcccggcggcgccccgccgctcgcggtgccgccgcacctggaggaggtgtgggccgtacgggaccgcggcgccgagccgcaccgggccgccttcaccggtatggcccgcgaggtgccgctgccccgccccgagctctacgacgccctctatgaccgccatatggagcccgccgcctggcggccctaccccgacgcccgcgaggtgctgggcgagctgcgccggcgcggggtgcggatcgcggtggtcagcaacatcggctgggatctgcgcccggtcttccgcgcccacggcctggacccgctggtggacgcctatgcgctctcgtacgagcacggggtgcagaagccggacccgaggctgttccaggccgcgtgcgacgcgctgggcgtggccccgggcgacgcggtgatggtgggcgacgaccgccgggcggacgcgggagcggcggccctgggctgccgggtccacctggtggaccatctcccggtggaccggcgtccggacgccctgcgcgcggttctcggcctgccgccggacgccgccacggccccctaggccccgcggaacgaagcccgaaagggatctcacggggcgaacccaccggttcgggcgatccccccatgccgcccgaaccggcggagacatacggcggccctcgaaggatcggcggacaaccgaacgtcgcctgagtatattggctgacagccagccaacgcaggagttacagcatggtcccccgaagcccgtcggtcaatgaggagttgcgccgccgatcccaggcccgtctgctggaggcgacggtcgagctgatcgacgagcacggctacgaggcgaccaccctcgcccatatcgccgaccgggccggggcggcc

SEQ ID NO: 2 - DNA, 86941 bp, Streptomyces hygroscopicus
cgggcggatctccacctcggtgtcgggtcgctgctgcgggcgggtcgcccagcggcggcgtacaggggcgtcacagtggcttccgcgcggcaggtgcggcgggccgggaagggcggtggccggccggcgacggctgccaggcgcgtagccgcaggctgttgccgaccaccagcagcgagctgaccgacatcgcggccgccgcgagcatggggttgagcaggccgaccatggccagcggtacggtcacggcgttgtagccgaacgcccagagcagattgacgcggatcgtggcgagcgcactgcgggcgaggcggaccgcgtccgccagggtctcgatgtcaccgcgtaccagggtcacatcggccgccccgatcgccacatccgtgcccgtgcccatggcgatgccgaggtcggcgccggccagggcggccgcgtcgttgaccccgtcaccgacgacggcgacccggtagccctgctcccgcagctcccggacgagggcggccttgtcctccggggtgcaccgggcgtgcacctcctcgatgcggaggtcggtggcgacggcgcgggcgggcgcctcgcggtcgccggtggcgagcaccggtcgcacgcccaggcggcggagccgctccacggcccggtagcttcccgggcgcagcacatcaccgacctcgatcagtgcctcggtctcgccgtcgacgcggaccacgaccggtgtacgggcggcggtctcggaggccgacagcgcctgagccaataccgggggcaacgcgtcgtccggggccaggacttcgaccagccggtccgccacccgcccgcgcacgcccttgcccggcagcgcgacgaagtcggccacggccgggagggactttccgggaacggtgcgccgggcatgggcggtgatggcacgccccagcgggtgttccgatccctgttcgaccgcgcccgccagccggaccagttcctcctcgccgagcccgcccggtacggcggtgacccgggcgacactcatctgcccggaagtgagggtgccggtcttgtccagtacgacggcgtccaggtgccgcagcccctccagcgcctgcggtccgctgaccaggacgcccagttgggcgccccggccggtcgccgccatcagcgcggtgggggtcgccaggcccagcgcgcaggggcacgccacgaccaggacggccacgctcgcggtgatcgcggcctgtggctcggcaccggccccgagccagaatccgaggacggtgacggccagggtgagcacgaccgggacgaagacgcccgcggccttgtcggcgagccgctgcgcccgtgccttgcccgcctgggcctcggtcaccagccgggtgatccgggacagttgggtatcggcgccgaccgcggtggcccgtaccaggagcaggccccccgcgttgacggcaccgccggtcacgggcgtgccggggccgacttccaccggctcgctctccccggtgaccagggacagatcgacggccgagctgccctccaccaccgtgccatcggtggccaggcgctcgccgggccgggcgacgaagacctggccgacccgcagttcctcgatcgggaccaggcgctcgccgtcgccgtcgcgtaccgatacctccttgccggccagccgggccagggcgcgcagtgccgcgccggtccccagccgggcccgcgtttccaggaagcggccggcgaggacgaacagcggtacgccgacggcggcttccagatagacatgggccacgccgtccgaggcggtgggcaccaggctgaagggcatccgcatcccgggttcgccggccccgccgaagaacagcgcgtaggaggaccaggcgaaggaggccacgacacccagcgacaccagagtgtccatggtcgccgccgagtggcgcaggccgcgcgccgcccgcaggtggaagggccaggctccccagacgacgacgggggcggcgagcacgaagcacagccactgccagttgcggaactggagaccgggaaccatcgacacgaccagcaccgggaccgcgagcaacgccgtgaccaccagccggtcgcgctcccgccgggcgtcctgcgccgcgtccctgtcctcgctccgttccttcctgggcggctcgggcagcgcggcggtgtagccggcctgctcgacggtggcgatgagctggtccgggccgacctcgggcgggtggttcacccgggcccggccggtggcgaggttcacggtggccgtgaccccgtccagcctggccagcttcttctcgacacgcttcacacaggccgcgcaggtcatgccgccgatggagaggtcggtcatggcggccaaggccgtcggttcgtcggccatcagcgtccactcccctggtccgtgtccatgccgcccatgtccatgccgccaccgccgtggccgtctcccgagccgccgtctgtcgtgctgctgccgtgcatgccgggggcgacgggcccggcgcccgcgccgacggcgtaggaggcggcgaacaccatcaccagcagcagcaggaatccgcacagcgccggcgggggcaatgccctggacaggaacgcacccggtgtccggcgggcagatgggcggggctgcgccatatgaggaaacttccaatcactccgtacggcttcagcggatccggccgtaccggtagaggagtcgggacgaccggcagccgagttccggcgccgtgctgtgatgcgcgtcatgacaccgggctcgtccggcgagcgcgtgacctgctcagccctgttcatagtggctcggtctgccgtcacggtggacgagacggccgagccgctccgcgcgggcgcggggcatgagcgtccaggtgccgtcggtgcggtgcagggcggccgaatgccagggggtggtccagacatcggcggcgtccaggaggcggatgccgaatttggcggcgccgatgggctgggggtggatggacagccgtacggagccggggtggtgttcggcgatcaggtcgccccaggcccggctgcgctggatgacgccgtaggcacgggtgcggcatgcgcgttggagggcggagcgggtgccggtgaagtcggcggtgtcgtcgacgaggaaccgggtgatgccccggtacagggcgagggtgtggtcctcggagcggacctcggctcgcagcgcctccagggtgggggcgtaccgctcgtgcacctgggcgcgcttggtgtggtggggcaggtcgcccaggatgtcgcgcaggtcgaagacggagaggcggtgcagtgccaactcccgtatgaggcgtctgagttcgtttgcgtaggcgtctatgtggtcatccgggacgcggatcaggtcgccgaagacatggccgtcggagcagatgatcacgcgggcgcccggcgggtggacccgctcgatctcctcgcacagggtgttcagaaagccgagggagaggcgttcgccctggtcggggaggtggccgagaaccttggcggggttgggcgacttgcaggggaagccgggcagggtgaggaccacgggttctccggcgcggacgaacccgccgatctggcgcaactggtgcgcgaacgactccgccgccgtgggcgtggggtcggtcgtgcggtggtacggcagcagcaggtccaggatggcggcgctcatgccgctcgtggagcgggtgtccggtgcggtcgtcagcggcatgaggtgggttcctccgtgagggtatgcgcgacgcgggcatgggggcatgcgggcatgcgtcagacgcgtcggtcgtagccgacgggcaggtggttggtcccccggccgaggacggccgggatccactcgatgtctccgtcgtcgatggccagatgcgctccgaggaggcgggtcaggagggtgcccagcgcgatctggagttcggcgcgggccagggccgcgccggggcagaagtggatgccgtggccgaaggcgaggtgggggttgggcgagcggtcgaggtcgagggtgtcggggtcggggaagcggcgcgggtcgcggttggcggcgcacagggagatgatcaccgagtcgccggccgggacctcggtgccgtgcaggtcgctgtcctggtcgaagaagcgccaggtggtcagctcgaaggcgctgtcgtagcggaggagttcgtcgaccgcgcggggcatcagctccgggttgtcgcgcagccgggcgagttcggcggggtggcggaagagggcgatcagggcggtggtgatctggttggtgaccggttcctggcccgccacgaggagctggaagatcatcgagtccagctcctcctgggagagttcgcggcggtcatgggccacgaccaggcggctgagcaggtcgtccgcccagtgttcgcgcttatgggcgacgacctcggctatgtagctctggagtccgtgcagacgggcctcgtacagcgggcgtccggggtcggccggtccgaccggctggacgaccttgccccagtcgcggtcgaagcgggccgccaactcatctggcaggccgatgacttcggcgaggacctggaaggggaagcgggcggcgaagccggtgaccaggtccgcggggccggtttccgggagggcgtccacgagggtgtcggccagcttctggaagcggggcctcagttgctcgatgcggcgcggggtgaaggcgtcggtgacgaagcgccgcatgcgggtgtgggtcggtgggtcctggtggaggaggtgcacctggagctgggagtgctggggctcgggcatgatcgaggcgcgggcgcgccagcggtcgttgccccggtcgtggttcttgccgaggcgctcgtcgcccagtgcggagtgcgcggcgtcgtagccggtgacgagccaggcgagtacgccgctgggaaagcggacgcggtgcaccgggccggtctcgcgcatccgctcgtagagggggtacgggttgctcttgtaggggcagcccatcagcggcacgggctcgggcagggcctcgggggccgtcccggattcctggagggtcatggaaggtgctcctcagagggcgagttcgggctggtagtggtccagccacagggcgaggtcgacgacgcgttcgaggcggaggcggtggccccactccagttggccgggcggggtgtcgaggcagggtttgaggcgggtctcgtcggcgagggagcggacggtgtcgtcggcgagggcgtcgcgggccatgttctgcaggccgcggttgtagtcggggtggtgggtggccgggtagtggttcttggggcggtgcagcaccgagtcgggggccagtccggtgcccgccgcacgcagcaggctcttctcccggccgtcgaagttcttcagggcccagggggtggtgaaggcgtactcgacaagccggtgatcgcagtaggggacgcgcacctccaggccctgggccatgctcaaccggtccttgcggtggaggagttgacgcagccagcgggtgagcgagaggtgctgcatctcgcgctgccggtgctcggtgggcgtctcgccgtcgaggtgcggtacggcggccagggcggtgcgataggtgtcgtcccggaactcgccgatgcgcaggtccagttcggggttgagcggcatcgcggcctcgtctccggtcaccagcagccagggaaaggtggcggtggcgagcgccttggggttgtggaaccaggggtagccgccgaagacctcgtcggccgcctcgccggacagggcgaccgtggagtgcttccggatctccccgaagaggaggtggagcgaggtgtccatgtcgccgacgccgatcggcgagtcgcgggccacgaccacggccctgcggtgctcggggtcgagcagggcacgcgggtccagtaccaccgtgctgtggtcggtgccgaggaacgcgcccgcttcggtggcgtacggggtgtcgtggccggtgcgcagcacatcaccggtgaagctctcggcctggtcgctgtagtcgacggcgtaggagcggatacgcgcgcccgggccctcgcgcagccgcagttcgtcggcgagcagggcggtcaggacggtggagtcgatgccgcccgacagcagggagcacagggggacgtcggcctcgagctgggcgcgggcggcggtgctcaccaggtcgtgcacccgggcgatggtcgcgtcccggtcgtccgggtgggcgtcggcctccaactgccagtagcggcgctcgcggatgccgtcccggtccaggaggagcagaccgccgggctcgacctcccgcacgccggaccacaccgtcggaccggtgttgaacagcaggctgtacgcctcgcgcagcccgtccgcgtccacccgtggccgtatctccggatgggcgaagagcgccttgggttcggaggcgaaggccagaccgccgtccacctccgcccagaagaggggcttgacgccgagccggtcgcggaccaggagcagccgctgggcccgctcgtcccagacggcgaacgcgaacatgccgtccaggtggtcggccaccttctcgccccactcggcgtagccgcgcagcaccacctcggtgtcgctgcgggtgcggaactcgtgtcccaggccgctcagttgtgagcggagttcatggtggttgtagatctcgccgctgtaggtgagcacggtggtcggggcgtcgggccggtcggtcatcggctggacgccaccggcgaggtcgatgacggccaggcggcggtggccgatcgcggcgcgcgggccgagccagactccggccgcgtcggggccgcgcggggccagggtggcggtcatggcctcgatgaccggggcctgggtgcgggggtcctggtgaaaggacacccagccggtgattccgcacatgggtgcgactcctcggtgagggtggggcggtggctcagcggggtgcggcgggcgccgcgtcggtggtcttctcggtgcggttcgcgggaccgcgggcgggccgggcgagcagcggtacggcgaggcaggcggcgagggcggcgagggcgagccccgcccgtacgccgtcgtcctggcccgccatcccccaggccgccgtggccagggccggtccgagggtgaagccgaggctgcgggcgagctggacggtcgagccgacggtggcggcgcggtccggcggggcggcccccatgaccagggcctgggccgggccgccggccaggcccatgccgagtccggccagggcgagccgccaggccacgtcgggaggggaccagccgtcgcccagcgggacgagcagcagcaggccgacggtggtgagcgcggcgccggtgaccgcgacgggccgggccccgtaccggtcggcgagccgtccgccgagcgggcccgccagccccatgccgagggggaaggcgagcaccgtcaggccggtggtggtcgcgctgacgtcctcgtcacgctggaggtggagggcgaccacgtagtgcatggcggcgaaacccaccgccagcgccagcaccgcgccatgcgcccgcagcagccccgccgcccgcagcacaccggccaccggacggccgcccggaccccgcagccaccaccacagcggcggtgcggcgacgagggcgagcggcagccaggcgggggtatcggaggccagggtcagggagagcaggaggatcgttacaccggtggctatcagggcggtgtcggcgaggaagcgccggtccgcgccgcgcaggcggccgtcccggggcatcgcccgccacaccacggccagcgccagcagacagaacgggatcttgaccaggaagatccagcgccagcccaggtggtccaggagcagaccgccgaccgccggtccggcgacggcgcccagggggccgagggtcgcgggcacgctcatcgcccgcccgcgcagctcgggccgcaccgagcggagcgccagcaccggcatcagcacgaacagcaccgcgccgcacgcgccctgtccgatccgggcggcgatcagccaggccgcccagggggacgcggcggcaagcgcgctgcacagcgcgaagccaccggtggcgaccagcagcgcggggcgggtgcccacgtcgtcgagccagcggccgacaggcaacaggagggcgacgacggggagttggtagccgagtaccgcccactgggcggtcgccgccggtacccgcaggccctgggagatgtccgcgagcgccacgttgacgatgttcatgtcgagcatcgccacgaacgccagcgcgcccgccacggccaccaggagccagcggtcatggacttcgggtggatccgccggccgctcgggtacgtccccggcctgatccgcaccggacgcgtcgtcggtcatgcacccctccctctggcaggtcggccgccgggcgacggcctcgctctagaagtcgggcgaaccgcggagtgagttcccggatgtatcaggaaaaacggctggatttcatggttcccatttcatagttcccggtggtcgaaggcgatcagcgggtccccggtcagcggatgctcgaccacggccgcacgtacgccgaacacctcggccagcaggggcggtcgcagcacctcgcggggtgtaccggaggcgaccacgcgaccctcgtgcaggacatgcagccggtcgcacacggaggcggcggcgttgaggtcatgcagcgacaccagggtcgtacggcgtcggccgcgcagcagggcgaggagttcgacctggtggcgtacgtcgaggtggttcgtcggctcgtccaggaccaggacgtccgtctgctgggcgaacgcacgggccagcaacacacgttgccgctcgccgccggacagctcgctgaagtggcggtcggtgtggtcccccatgccgacgtccgcgagagcacccgcgacgatgtcccggtcggcggcgtcctccccggcgaacgcccgcttgtagggggtgcggcccatggcgaccacctcacgtacggtcagctcgaagtccccgccccgctcctgtgggagcgcggcgatgtgccgggccgaccgcgcggggctcagctcgcggatgtcggagccgtcgagcagcacacgtccggcggcgggcttcagatgccggtacacggtccgcagaagagtggacttgccactgccgttgggccccaccagaccggtgatctcgccttcggccgcgatgaggtgggcatcggccacgaccgtacgtccggcgtacgcgacccgcaggtcctcgatatcgatcctcaactcccgctccccaagcgccggtccagcagatacagcagagccggagcgccgatgagcgaggtgacgaccccgaccggcagttcctgcgtgtccatggccgtgcggcacacgatgtcgaccaccaccagcagcagcgcgccgaagagcgccgacacgggcagcagtcggcggtggtcgccgccgacgacaaggcggcagacgtgggggaccatgagggcgacgaaggcgatggccccggagaccgcgacgaggacgccggtgagcaggctggtgaccgcgaacagctcacggcgcagccgtacgacgtcgatgccgagcccggccgccgtctcatcgcccatcagcagcgcgttcaggccccgggcccgggcctgcaacagcagcaggaccgccggaaccgccaccgcaggggcggccagcagcggccagctcgccccgctcaggctgcccatcagccagaacagcacactgtgggtctgctgctcgtccccggcctggagaacgaggtagctggtgaagccggacaggaactgcccgatggccaccccggcgagcaccagcctgagcggcgcgaatccgccaccgcgccgcgccaccgcccagacgagagcgaaggtggccagggctcccgcgaaagcggcaccggacagaccgaggcccagcgctcccccgctgccgaggccgaggacgatggcggcgacggcaccgagggaggcgccgttggagacacccaggaagtacgggtcggccagcgggttgcggacgagcgcctgcatcgccgtaccgaccaggccgagcccggcacccaccagggccgccaacagggcgcggggcaggcgcagttgccacacgatcaggtcgttcgtgccgggccggggcgcgtcgccgctcagtctgcgccagaccacgctccacacctcaccgggcggtatcgacgtggaaccccaggcgaccgccgctgtgagggccgcgagcaacgcgaccgccaggagcagcgccagcggcccggcgggcatggagcgccgggtgcgcacacgggcatcggtgcccttccggctcaccgtggtgtcgagcgccatcagccgatcttgcccgggtggagggccttggcgatctccttgacggtgtcggcgttctcgactccgccgatggtggtccgctcggagccgatgcgcaggaagtggccctccttgacggccttcaggcccttggtggcggggttcgactccagccacttccgcgcctcgtcgaacgccttctggttcgccgcctcgctgccccgatcgcggacgcccaactggatccagtccgggttccgggaaatgacgtcctcccagccgacctgcttgtagtcgccgtcgcagtcggcgaagacattgcgggcaccggccagagtgatcaccgcgttggcgacctggcggttgcagacgacggtgggctgcttggtgccggcgtcgtagtcgaagaagaagtacgtcggccgctcgccctccgccgtccggccgaccgccttccggacggcgtccagcttccccttcatgccgtcgacgagttccttcgccttcgcgctggtgccagtgaccgcgccgagggaggtgatgtcggcctccaccgcggacaggtcggtcaccgcgcccttgttccgcgccgcacaggcggtggacttgaggtagatgtgcttgattccggccgccttgaactcctcctcggtcggcgcgtcgcccatgccgccgcccatgttcatcgaggcgaaggtgtcgatgtacagatccgcgccggagccgaggagcttctccttcgggatcacggactgcccgagcgccttcaccttccgcgcctgcgcgtcgagttcaccgggcagcgttcccttgccgggcgggaagccggtgccgatgacgttgtcaccggcgccgaggcgcagcagcagttccaggctggaggcgttgctggtgacgatcttctcgggggccttggagaacgtggtcttggcgtccatgcaatcggtgacggtgaccgggtagtggccggtggccgacttctcgtcggcggggcccgccttgtcaccgccgccactgccgcctccgtcaccacagcccgccacgaggaggccacccagcaccgcggccgtcgtaccccaccacacacgagaacgcatcgaaactctcctggatccacttgatacccgggttgccccggatcagtagtcgtggcggatacggcatcggttcccgctcagtgggagccggtgagagtctctgaacttgaagggcagactaggtacgtggcgtcggtgacgcatggagtcgacaggagagaacgtgcaccgcaaactccgcctgcctctggggcggctggcagccctcgtctgcacatctgtcatcgccgtcacgggctgtggcggcggtgacggcgaatccggggctccggagccgacctcgaagccgaccgccggcgccgggctcatacctgtcgcccaagcctgcggcggcctgttcgacgaggccatcgcgaaagaggcccgggagccgaacgggcccagcgaggtctatccggtcgagaccgagagcaccggccacgtggcgaagacgctgcggaaggagtcggccaggaggagcacgcccgaggacctctgtaccttgacggacaaggccgaggggaaggagctgctcgccctcaccgtggcctggactccccactcactcccgtcgggccggtcggtgcgctacacgaccaccgtcggtccggaggacgccggcaggctcctggtcgcgtgtgacatcgacagcggaagggggacggagtcgggcgggggtcgttccctggagttcgccctgcgcgaccacttcaccgtcagcgaccactcccacgccaaactgctcatcgcctcggcgaagaggacaacgtcgcagctcgactgccgggaagcgcccgaatacccggacccgaaggttgtggcaccgccaccgaagcccgggctgcggtagcgcggtccttccaccctgccgcagatgatggcggtttaatcgagtcatgatctaccacgtcgtaccgcttgccgagtggaacaccgctcccgaccgcccctacagccccgcatccctcacggaggacggtttcatccactgctcccccgacgaggcgaccacgctggccgtcgtcaacgccttctaccgcgatgcgccgaggccgctgctggcgctgctcctcgacgaggaccggctcaccgcgaaatgcgaatgggaggccgcgaaccccgccccgccgcccggcgtcgccgagaactgcctgtttccccatgtcttcgggccgctcaaccgcgaggcggtggcgcggatccaggagatcgtatgggactcggagagccgggcggtggggttgacggatgtgcgcccacgctgacgacgagggccgtcagagtggagcgaggcgggccttgagcaggcagaactcattgccttcgggatcggcgaggacgtgccactgctcctccccggtctggccgatgtcggcccgccgtgcaccgagcttcaggaggcgttcgagctcggcgtcctgatcgcggtcggtggcgttgacatcgatgtgcagccgggatttcccgggctccggctcgtccctgcggctgaggatgatcgtcggctgcggaccgccgaacccttcgcgcggcccgatctcgagggttccgtcgtcctcgcgatcgagcaccacgaagtccaggacctcgcaccagaatcgcgccagcacctcggggtcgcggcaaccgagcacgagttcactgatacgacatgccattgacgaaacctactctcagcgtgggtactgccggggtggccgcgcgcagatctcagaggcttcccgcagtgaggactctcgggaccgtaccgggcgaggcgagcagtggcgaatggatttcaggccctcgcctgcctgtctccctcgggacgctcgccggggccggagccggagctgggactgaggctgggactgacggcctccgcagccgagtgggcgccttcggccccgtatcggcgcagcagccacaggccatacgcggcctggaagacgaacacgctcacctgccaccagtccggggccgagcccggcgagcggatctggaagaagtcgtcgagcccatggacgacgaccatcggccagaccgagccgatcgcgtaacgcagacccgcacaggtgaagccgaagagaccggcggacagcatctgccacagcgtgtcgtcgagcggatcgccgaagaacaggaagttctggaggtgtcctgctccgaataagacggcgacgccgacggtcgcgcggatcggaccgagcgggttgagtgcctgctggacgaggcccctgctgtagatctcctcgttgatgccgacccacagcagcgaaaccaggccgctgacgatgaccgtcgcactgccgtcgagacccgccacggtgtacgaacaggcaatgagcagcatcggcgcggccggccaccagcgtcgtggacggccgagtacggccaccgcggagcggcgcagccagccccaccgccacaggacgagccacacccccgcggcacagatcgcgttgaccagggtggcgccgagatccggataccacgagggcgccagcggaggcaggatcacctcggcgaacagcagcagcaccgcatgccatgcgaaggtcaactccaccgcgccccagagcggatgacggatgacgtggcctttccaccgcttcatcacgagaccgagcgtagccgcggacaggacttcgtggcaggcggccgcacagcccagaagctgggcctgctcggtcggcgtcagttcgtggcggttgccaccgtccggctctcatcggccgtcgcgggcctgggattcagcaaccgctcggcaagctcaccgaagagaagaccgaacccaccccacagaatcacctgcatggccagcgcggacaaccggaaccgccacaacaccgtggcgggaaagtcccccggcacctcattgaccacaggcaggaaggcaaacgccaccccgatcaccacggcgaacgccgccaccgccaccacggtcgcataccaggtacccaacctcggcacgagccgcttgcccaccatcgtggcccccaccgccaggagcacactgagcaccatcatcaggaagtacagcgccgtacgcttaccgatcgtgtcggcgttaccgaccgcgggcggattggccggatacttcaggaacggcaccacatacaccgccagcagcgcacaccccgacagcaacagcgcggtggcccgcggcgtgaaacggccgacacggcccagggccacgcaatacgccagagcggcgataccaccgaaggcgatcccatagaccaggacaccggtggccagcccggccgtggactgcacaccacgcgaaaccagctcgacctcatgctcatgcgcgggagcgtgagccccctcgaagctgatcgcacggtccacgttcggctcaccgaggaaataggcggcgaccagggccggcacaccggcccccagacccgcgagcatgccccggatcagcagatttctcaccattgcggagttcatgactatgcggcgtccctcacatcagtggcaggggaaaccgagcagatgacgggcgtcatgcacccactcatgaacgttctcaccggagacaacggcggtggcgccctgctcggcgccgacgaaatacagcaggaccagcatcaggatgccgaagaagaccgcccagggagctatcgccttcagcggcagcgtggcgggcagttcgggggtggtggcagtgggctgcgcgacatgctgcgccatgaccaggccctccttaagggagttcgcgtcccatctcggtggtgcacaggacgacggctacgggtctgactcaccacagatcccgtccgggacccctggttcacagtggcgcgaccgtgccggattcccaccggcttccgtcttaccgtcgtcgatatcgcaccgaccgtaccgcgtgtcgggttcatggccaagaccgcccacctggcgagacgctgcgccgggacgtcctgaggacggtgcgggagccggggcctgcctcgggcaggccctaaggtcgcggcatgcgcatcgtctccctgctgcccgccgcgaccgacatcgtcaccgaactcggactcgccgagcacctggtcggccggacgcacgaatgcgactggccaccgcggaccgtggcgtccgttcccgtggtcaccggagccgacctcgaccagaacaccctcaccagccgggagatctccgacgcggtcggcggatcgacgcactccgggtcgtccctctacaccctcgacaccgaagcgctcgcggccctgggccccgacgtggtgctcacccaggatctgtgcgaggtgtgcgccgtctcgtacgagagggtcagccgggccgtccggctgctcgacgccgacacccgcgtcctcagcctggagccacgcacgctcgacgatgtactggactgcctggtcaccgtgggtgagctgctcggcgtgcgcgagcgcgccgagcagcgccgggccgagctgcacgaccgcctcgagcggatccgccggtcggtcgcgggccgcgcccggccccgggtcgtggcgatcgaatggctcgacccgctgtggcccgccggacactgggtacccgaccagatcagcgccgcgggcggcgcaccgctgctcgccgtgtccggcgagcacaccaagccgatgacctgggaatcggtgcgcgccgcccgcccggaggtggtgctggtcctgccgtgtggcttcccgccggaacggaccctgcgcgagacggaactcctcacccgcctcccgggctggacggaactgcccgccgtacgggccgggcgggtctgggtgctggacgggccggcctacttcaaccgcccgggccctcgtgtggtgcgcggagcggaagtactcgcccacgtcctgcacggtgtacgggccgggaccgcggtgacggcggacgaggcacacccgttcccgggcgcccccggccggtgacgcggttccgtccgcccaaaagccacggcaagtgctcggcgcttcttgcatacgatgcgctgatgcataagatgcgcaccagtcttggctccctctcggacgacaccccatgacggacctgatccgccgcgccctgaccggccgagccgcccggacggcgccgaccccgaagtccccgcgtgagcgcacctggaggcatctgtctccgcttctgcggctgctgatcctgacccaactcgccttcaacgtcggcttcttcgcggtcctgcccttcctcgccgagcacctgggcaccgcgatcggcatggcgggatggatggtcggattcgtcctcggtctgcggaccttcagccagcaggggctgttcgtggtcggcggctggctggtggaccgctacggcgtgcgccccgtcgtgctgaccggctgtgccgcgcggatcgcgggcttcgtctggctcggctacgcggagcggacctgggcggtgatcggcgcggtgctgctgatcggcttcgccgccgcgctgttctcccccgcggtggaatccgaagtggcccggcaggcggtggcctgggagggggagggccacggttcgcgcacccgggtcctggccctgttcaccgtctccggccaggccggtaccttcgtcggtcccctcctcggcggtttgctgctcggcgtggagttccgcgccgcgtgcctcgccggagccggggtcttcgtcctcgtcctcgccgggcacgcctggctgatgccgcggcacatcccgggccgggtccgtaaccgggagcagggcggcgtccgcgcgatggtgcgcaaccggcgattcctcgccctgtgctgcgcatacggcacctatctgctcgcctacaaccagctctacctggccctcccggccgaagtggagcgcgcggcgggctcccaggtgccgctgtcgtggctgttcgccctgtcttccctgctggtcgtcttcgcccagctcccggtcacccactgggcgggcaaccggctcgatctgcgccgctcgatgaccatcgggctgctcctcatcgccgccggtttcgcggtcgtggccgccgcgcgcccggccgcctggacgggcgccgtcggattgctgcccgccgcgggctacgtcgtgctgctcaccctcggccagatgctggtcgtcccggccgcccgcgcctgggtgcccgacctcgccgaggacggtcggctcggcctctacaccggggcgctgtcgtccgtctcgggcctgatcgtcctcatcggcagctcggccaccggctccctgctcgacctgggccttccgcccgccgcccgctggctcgtcctcgccgccgtcccggccctcgcggtgacactgctgccccgccgcccggatcagcccagggtgagcagctcctcgtagaagccgccgaactcgcgttcccggtcgacgaggtggatctccaggatccagtggcagcggcgtccggccttgtcggtgtgccgcagcggggtgtcgttgtcgggcgtgatgtacgactccacgcgcgcgccgtcgatcgtctcgtgcgggaactccccgaccaggtggccggcgtgccagccgcccagctcccagccggccccggcggccagccggtccacctcggcgtgccgccgcttcccggtgatctccgggtcgctttcgaagaaccgcttgcccgcgtcgaagaccttgggcagatcgtcccgcagccgccgcttgaccgggtcgtcgccgaggacgaaggtccggccgaagtcggcctcgtactcttcgaagatcggtccgaggtcggcgagcacgatgtcgtccgtgccgatcacccggtccggcggattctcccggtacggcaggagcgtgttcggccccgagcgcacgatccgcttgtgccagtgccgggtcgtgccgaacatctcgttcgccaggtcccggatccggtcgctgaccgcccgctccccctcgcccggcgccaccagcccgcgcccctggatctccgcgaagagccgtacggccttcgcctgggcatccagcaaccgtgccgcgcgcgcgggttcgtcgtccgccatgggcccgacggtaggccgctagatcgtttcccggcaaccggatgaggcagtcctcagtcggcgcggccggtcgccgccaccgtcacacccaggccgatcatcgcgaggccgcccgccccgccgaccatcgagaggcggcggtccgagcgggcgaaccaggagcgggccgccgaggcgcccaggccccacaaggtgtccgtgaccaggccgatggtgaccgggaccaggcccagcaccatcatctggacgggaacatgacccgccgagtggtcgacgaactgcggcagcaccgccgcgaagaagacgatgcccttcgggttggtgacccccaccaaaatgccgtccaggatcgaacgcagatcaccacgccgctcatcggccggagcgtccatgttcgccacgcgcatctccctgcggtgccggaacgcctgcacacccaggtagacgagatacgccgctcctgccagcttcacgcccatgaacagcgccaccgagctctccaccagcgcgccgaggccccacgccacggcgaccaccagggcgtagcagccgatcacattgccgaggaccgtcgcgagcgccgtgcggcggccgtgggcgagggccctgccgaccacgaacagcacactcggccccgggatcacgatcaccaagagcgacatcgccgcgaacgtgagaacactctccgtggacaccacgtgtccgccacctcctgaatcgctccgtccaggggacatacaaacagatgacggaacgcccgctccagcctcaggcacccgcggacagtggccgctcccctacttggtcacggaataggagtgcgctccggttccggcgagtgctcccccgtccacgatcaggtactcgtcgcggatgggccgccccatgggccaggactccaggatctcgcgggtgcccgccgcgtaacgggcctgcgcggacagggtggagccggagatgtgcggggtcatcccgtggtgcggcatggtgcgccaggggtggtcggcgggggcgggctgcgggtaccagacgtcgcccgcgtagcccgccaactggccgctgcgcagggcacggtcgacggcgtcccggtccacgatccgggcccgggccgtgttgatcaggtacgcgccgcgcttcatcgtggcgagcagttcgtccccgaacaggccctcggtctcggggtgcagcggcgcgttgatggccgggccacgcagtccgcgatgttccagccgccgtcgagaacgacctggtgggagggcagatagttccgcaccagggacagggtcatcatcaccacgtgctcggcgacgctgatgctgttggagtacctcacctcggcgaccgtcaccccgtgtgcgatcgccgcgtcgaggtcgacgtggtcggagccgatgcccgcggtgatggcgagcttcaggttcttggcgacggcgatgcgctcggacgtcaggtacgcgggccagaacggctgcgagatcacgacatcggcatcgggcggctctcggtcgaacaccgagccgtcgccgtccttgtcggaggtgacgtgggcaggtgcggttcaccatcctcgccgctgaacggcctggtcaaagcgaatctcgctatgctcgtatagtcggcggctatcgcccgtgtccgttgaggcaggtgtgcaggcgctcgtccagcgcctgccgtacgtcggcctcccgggccaccgtgagcagcgccccggcgaggacggagggcgggtcgtcggggccggtgaccagcccgacccgcggcccgtgcacgggcccctccaggggcaccacccgcatgccctccggtacgccgaacatatgcagccaggcgtgcgagatcacgctggaccagcggccgccgggcaggtgggcgtacagcccggcgacgctgtccgactcgatggcgggcgtgacggtggcgccgtcggcggcgaagcactcgtccatgatgcggcggttgcgcatccgcgggccgagcaggcacagggggaggtcggccgcctgcgcccagcgggccgtggccgcggtggcgagcgagccgtcgacgggtgtgacgtatcgctcctcgtacagcgggagccggcgcaggccgcccagggagtcgtcgtcgaggtaggtcatcgccgcgtccagttcgaactcggccagcccgtgggtgatgtcgatcgaggacagtgactcgatgctcacccgggccctcgggtggctttcgcagaaggggctggtgaggagggacgcggcgggcatcgcggtggggatcactcccaggcggagggtaccggtcaggccgtcgcccaacgccgacagctcctgccgcagcccgtcccgctcggcgaggatgcggtgtgcccacgccagcaccacctcgccctccggggtgagcccctcgtaccgtcgtcccctgcgcacgatcggcacaccgagttcgtgttcaaggcggcggatggcggcggccagcgacggctgggacacatagcaggcggccgccgcgcggacgaagtggcgctcgcgggcgagggcgaccaggtattccaactggcgcagttgcatgcgtgacctccacgacgcgtcccgtcccgagggcgcggcgtacagcatcgtgcaggctgcggctgtccgcgaggtggtcgacgggtggggagttcggtgtcgctcaccagcacacggccgggacccgcataaagggccccggccggtgaatcggacgaccttcgagacgggtccggccagtgacggtgacccgaacgaagctgcttacgactgagcgccggacgcgggcgcgttgaggttctcgtggaccgcgcgggcgatgccctcgatgttggcgatgccgtcgtccatcgtggcgttgtcctgcgagagcaccgtgatcgtgtagtcgtggtcgccgccggtgaaggcgccgaggctgtgcacccgccagccgttggtggcccgctccagccacccgttcttcacatgcacctgggcgtcgctcggcgcaccggccggggtgccccagcgctgcgaggggatgacctcgcccgtcagcttgaggatgtaggcgcgggagtcatcgctgagcaccgggttgctgtgggtcaccagttggaggagcttttcctcgtcgttcgcggtgatctgggtgagcccccagtggccctcgctgtcgagggtggtgttggtcatccccgcggcgtgcaggaacccgttgatcttgtcggccccgagctgcttccacagcgcggtggtggcgtcgttgtccgacttcgtgatcatggcggtggcatggtccttctcctcctgcgtcagggcgcgatcgtccttctgcgcgtcccacagcagggtgccgagcacggtcaccttgaccgtgctcgcggagtcgaagtgccggtccgcgtccagagtgcaggtggtgttcgtggtgcggtcgtggaggctgatcgccgtggtggcggcggagccctccagtgccgagttgatgtcctcggagagcttgtcggcgagttccggccggtccgaggtgcagatcgccgcctgcggggtggccgcgtgtgccgaccccaccgaggcgatcgtcggcacgagcacccctgcggccagcgccgcctttgtcgccagggtgctacggggaggctgggttattcgtcggtgtcgacccatggtgggcttgtccattcgttcgtggggcagttggacacgcggtgccttcgctccgtcgcgaagccatccgggtgctccgaccctggatgacgagccggaggcaggtgaggttcacgaacgcgtccaagtctcacaagatcgctccacaataggcaccgcgcccgggcggaccgggcgcggtgcggcggacgagccgggacccggtcagcgccgaatggccctgaggaagtctccgagggctcgggctacggcgccgggggcttccgcggggagcaggtggccggcgtcagggacggtcgtcagggtcgcgtgcgggatgtggggcaagaggtgttcgcgcaggatgtgcggcggctccaccatgtcgttctccgcggcaagcaccgtcaccgggacctcgatacgccgtgtggcatcggtgatgtcccgcgcgattccgtgcaggggccactcctgccgggcctcggcgccggaggcgaggctgtcgcgctccgcggtggcccgcaccgtctcgggcagcggtgtggcggtcaggacatggtcgagggcgtgcgccaccgtctcggccgagtcgtaggcgtgtgacaggccctgtcggtactcctcggtcaccatggcgggtggctggggcggtgcgggcgcgacgagcaccagaccggccagaccggccggtcggcgggccgcgacgagctggctcgccttgccacccatcgagtggccgacgaggacgaacggccccgatacccgctcctcgaccacacggacgagatcgtcggcgagctggtcgaggtgatagggcccgggcagcgcccgcgaggtgccccagccgcgctggtcgaagcggaccgtcgcctgcccgggcggcaggtggccgagcacaccgttccaggtgtcggcggagccgccccagtagtgggcgaacaccagcgtcggaccggtatcgcccccgactcgcacatcgagcgatccgcccgccacgggaactctcattgtcatttccatcatcttcgcgccttccctctcggccgcggaaggcgactccgtcgtcctgccgcagctcggaaccagtaacctgacctgccgatcaggcgcggaatcgaccgtaggcgagggagtgtccactccttggcggaaaggaacacgttcattgtggaaaacggacacagtgcggtgcggcaactgcgctatctgcctgccgtgggatcggcgtacggggtggaggtcctggatttcgccgcgctgcgttcgatggacacccagcgccgtcgtacccagccgcagcgccccgacttccatgtgttcgcgctggtcggctccggaaccggcagccatgaagcggacttccacaactaccggctgggggaaggcggcgccgtgtggatccggccgggcatggtgcaccgctggagcgatatcgacgcctgcgacggcccgctgatcctgttccggcccggtttcctttccggcttcacggcggcagaggccaccacaccggcgtgctggcatctggaccggcagcggctgcccctcgccctgctcgcggccgaacatctcggccgcgagcacagcacggcagtgcacacaccacgcctggcatcccccgccctgctctcccacctgctggcggcgctgatcctgcgcgcactcccgggcacaccgccctcggccgaggcggcaagacccggcagccggccaaccgaagtgttccgggtctatcgggccaccgtcgaagagcgcttcgccgaatggcaccaggtggccgactacgcacgggcgttgggctacgacgtacgcaccctcacccgggcaacgcgcgccgccaccggcacgggcgccaagacctttctcgaccagcgcatcctgctggaggcgaaacggctgctcgcccacaccgatctgccggtcagcggctgcggccgacgcctcggcttccgggacgtcggcaacttcaccacgttcttccggcgccagaccggcctgccccccgccgcgtggcgcgccgcgtacagcaccggcggcacacgcggcgtctgactcgccctcggcggccggggtccggagagtcactgatgtgcgggggcaggttcactgttgcgggggcaggtgccgcaatccgttctccagcagggcgaaggcgtgctccatgtcggccacggcacccgcgtagcgctcgtcggccggctccccgtacgccacacgttcggcgttgtcgtctgccaacgcccagtggaccgcgacgatttggacggcggcgagccgcgcggtgagttccggaatgtccgccgtttcccgcagtgcctcggtcagggcgtgctcggcgccggtcttgaaccgtgccatccgggccaccagcgagggcgcgtcgaggatcatgcggtgcagcctgcgcaccgcgggatggtcattgagcccggtgatcggatcccgctcgcgcagccccttgagaaagtgctcgcgcagtgcggtcagtgggtcggtgcccggcgggcgggcccgtacgacgcgtgcggattcggtctcgtggtcggccaggcggtgcaccacgaggtcttccttggtcgggaagtaggcgaagagggtgcgcttggacacctcggccgcctcggccacctgggccaccgagacctggttgaagccgtgttcgagaaacagcgagatcgccgcgtcggagatcgccgcgtgggtccgctgcttctttcgttcccgtagtcctggcttgccgtccacggcgtccacggtaacagaaaactgcccctggtaaatttctgcaccgggtatatatttaccctcggtgagctgatccggagcgttgagatgagatggagtgacggtgttgacggagagcacgaccgaggtcgttgtcgcgggcgcgggcccgaccgggctgatgctggcgtacgaactggctctggccggggtcgagaccctggtgctggagaagctgccagagcggatccagcaggtgaagggcggcacgattcagccccgcaccgccgaactgctggaatcccgcggcctgctggagccgctgctgcggcgggccatcgcgcgtggtccgatgggcggccatttcgcggccctgcccgtgcccctggactgcaccccctggcggaccgagcacccctttccgatcgggatccctcagtgggagatcgaggaggtgctcgaagagcgggcgaccgccgccggcgcgcgggtactgcgcggcgccgccgtctcaggggtcgcgccggatgacgatggtgtggtcgtcacggcggacggtctgcgggcgcgggctcactacctggtggcgtgcgacggcggccacagtacggtgcggaaactgctcgggctgccgtttcccggccgggccggaacgcatcaggcggtgctggccgatatccggctgtccgccgtttcctcgctggtgccgcggcaggcggggcatatgagcaccctgacccgtcaggcgcggggctactggtccatgctggtccctgtcggcggcgaccggtaccggttcaccttcgggcatgcggaccaggcggacaccgcccgcgacaccgccgtcacccacgaggagatcgcggccgcgctggaggccgtgtacggccccgagaccaccctcggcggcgtggacaactcctcgcggttctccgatgccacacggcaactggagcactaccgcacgggccgtgtcctgttcgccggggacgccgcgcatatccaccccccgctgggcgcccagggcctcaacctcggcgtacaggacgcgctcaacctcgggtggaaactggccgcggtcctccaggaccgggcgccgagcgggttgctggacagctaccacgccgaacggcatccggtcgcggcccaggtcctgcatcacacctcggcgcagcgcgtcctgacgagtccgaacccgagcgaggacgtggccgccctgcgcgacatcatcaccgacctgctgcgcctgcccgacaccaaccgccatctcgcggggctgatgtccggtctctcgctgcgctacgacctgccaggcgatcacccgctcaccgggcagcgcatgccggacgccgatctggtgaccgagaccggcaccacccggctgtcgacactgttcggctccgggcacgccgtcctgctcgacctggccggagccgtcccggccgacctcccgctcccgccacgagtcgacctcgtccgcgccacatgcgccgacgatctgggcgccgccgccctgctcatccgccccgacggctatgtctgctgggctacggacaccaccgccgcctgcggcgacaccctgctggccgcgctcaccggcgacctcgcgagggtgcgctgagccgggtgacaaggccgagtgacaaggccgagtgacacggaggacgcctacgcgaaggccctcaaggtgtcctcgccgtcggtccaccagacaccgagccgctggcggaccaggagccagccgtccgggccccggcggaattcccagtcgtaggggccgcccatggagtagggggaggaggtgctcccgggctcggtgacggcgacgaaccacatgtagccgatccccgtcgcccggtcgcccgccacgtcgacgtgcatgttgaggatgtgatgctgcatgctcgcgtagggtgattccacctcctccaccttggcccggaccgcctcttttccgtggatcttctcccacggcccgaactccagcaccgcgtcctcggcccagcattcgatccaggtctgccagtccttgcggtccagcgcccgccatccgcggatcatgagggcgcgcagggcttccttgtcctccagtgcctggagtctgcgggccaggctgtcgtagtcggcggtcgctgtcatgacgggcctctttcgtccatgggtgctggtcggtcctgcccgatcgagtctggaccggtcgagcaccgccgaccaggccgaacgccgcctaggagcaccgcacccaggcggcacaccggcgggctcatggagggcagttgggccacggccaggggtgaccgaccccgggcggtcaggtctccagcaggtcaggtctccagcaggtcggggggaagatctcctcgatcgtccaccggtgtgcggtcaggccctgctcgtggtggtagcgcagcagtgtgtcgagggccgcgcggttggcggccacgccatagggccaccagtcctcggtcatcagctcggcgttctcctcgtacagcgcgttcagccagggcaccatgaacggggcctcgtacagtcgccgtccctgccggtaccgccgggctcctgcctccttcgccgccacaaagccctcgtagacggcgcgggccggccagggacaccggccctgtacagcgccggttcccgtgccggtgcgagcgggtcgccccacaccgggaccgtgcccccgaaccaccgtaagtccgcaggacggggcggcgcggccaccgcacaccatcggggcggccggagcggccgaagccccctcattccccctgacggccactgccgccaccgtggtcagggggaatgagggggatgtttaggggacggcccgctcgccgccggaacaagaatcacaacaacagcagcgagcttcctcaagctcgttggagctttctctcccgggccttctttcccttgggccgcgcaaccggagcgcggctgtcccgcgcaaggggcgatcccgcgcgggccggtcgctcctcccgcgcgccctgcttcgaaccgagaggtgtggcggcatgctacggactgacctgatccggccggtgcccgaactgctccgggccaacgcggatcgcttcggtgacaagccggcctgttccgacggacaccgcacggtcagccatgccgaactcgaacgccgtacccggcggctggccggtcatctcgccggactgcggctgcaccccggcgaccgcgccatgatctgcctgggcaaccgcgtcgagacggtggagagctacttcggcgttctgcgggcgaacggcgtggcggtgccggtcaacccgcgttcgaccgatgcggaactctcctatctgctcgccgacagcggcgcccggctggtgctcaccgatgtcgcccacgccgagcagttcgaccggctgcgggaacagttcccggagctgagggtggtggtcagcggggacgggccgctgccgaagggcttcatcgcgttcgagccgctgccggacacggagccggacctggcggcccgcgacgacctgggcctggacgaagtcgcctggatgctctacacctcgggcaccacgggcctgccgaaaggcgtgctgtccacccagcggaactgcctgtggtccctggccgcctgctacgtaccggtgacggggctgaccgccgaggaccgtgtgctgtggccgctgccgctgttccacagcctctcgcacatcgtgtgtctgctggcggccaccgccgtcggggccggcacccggatcgtggacggggtgtcgacctccgatgtgctggacgcgctgcgcgaggagcggtcgaccttcatcgccggagtgccgacgctctaccaccatctgatcgaggctgcccgcgagcgcgacttcgccacgcccgagctgcggatcgcgctcgtgggcggggcggtggccacggccgacctggtcaggtcgttcgaggccaccttcggagtgccactcgtcgacgcctacggatccaccgagacctgtggcgcgatcgcggtgaactggcccaccggcccacgggtcgaggggtcgtgcgggctgccggtgccggggctgacggtgcggctggtggaccccgacaccggtgtcgacgttccggccgggcgggaaggcgagttctgggtgtccgggccgaacatcatggccgggtaccacaaccagccggaggcgacggccgcggcgctgcgcgacggctggtaccgcaccggggacctcggccgccgtgacgaggccggattctgcacggtgaccggccggatcaaggaactcgtcatccgggccggggagaacatccaccccggtgaggtcgaggccgtgctgcgcaccgtgccgggtgtggcggacgcggccgtggtgggcaagccgcacgcggtgctcggcgaggtcccggtggccttcgtggtgcccggcccggacggcttcgacccgtcggcgctgctggccacgtgtcgtgagcggctgtcgtacttcaaggtcccggaggagatctacgagatcgcgcgggtgccgcgcaccgcctcggggaagatcacccggcacgtactgctggagctgcccgcacggctgcgggccgccggggacggccagtacgactcgctgctgcggctggactgggtgccgcatcccgcgctgccggacgccccggccgggaccggaacctgggcgctggtggacgcggacgcgctcggggccgggctcgcggaggggctgcgggcggcgggggtggacgtggccgatccggtggccgattacgtggccgatccggtggccgatgtcgctggagatgacggtgcggctccggacgtggtcgtggttgcgcctcaggtggtgggcctccccgaagaagcgggggtccccgacgaggccggggtcacggctggcgaggcggccgaccggctggcggcccggctgggcacctggctggccgacgaccggctggccgggacgacgttcgtggtggccaccactggcgcggtggccaccggctccgaggagaacgcaccggagccgctgtcggccgcgctgtggggtgtggtgcgctcgctccaggccgcctaccccggccgactgacgctggtggacgtggacgacgaagggggcggggccggggaggacggtcgggtggccgcgctgttgcgggccgtacaggacgggcacgaccaggcggcgatccgtggcggagtgctgctggtcccgcgcctgacgcggatctcggtcccggcggagccggggcccgccccggccctggacccggacggactggtcgtgatcaccggtggcgacaccgcccgcggcaccgcgctggcccgccatctggtgaccgcgtacggcgcccgtaacctgctgctgctcagcgcgaatggcctgccggaagaggcggcggccgcgttgcggaccgagttggcgcgggacggggcccaggtctcgatggccgtgtgcgacccggccgagcgggcggcgctggactcggtgctggacgcacaggaccggccggtgaccgctgccgtacacatcgaggagccgggtccggaacggtcgctcgccacctcgctgcgcggcatgacgcacctggaggaacggacgcggacggccgggcccgcgctgttcgtcgtcgtcacctccgccgcgggggtgctgggctcgccgggtcgcccggacctggcggccgtcgaccagttcggcgaagccctggtgcggcggcgccgggcgctcggcctgagcgggctggcgctggcttgggggccgctgccgggcgagcagggcacggcaccggtggccggtgccgttcccctgcccgaggcgctggccctgttcgacgcggcgctgacggctggtcagggcccactggtgctgctcaggccgagtacgacggggctggcgggtggcgagccggtgcccgcggtgctgcgtcacctggtggacgcgccgtccggcgtaccggcgtcggacgaacccgccgccgcggagttccggcggcggctggccgccgagagcgagtccggccgccggcacatggcactggcgctggtgcgcgagcacgccgcggcggcgctggggctggcctcggccgacccggtcgaggccgaccaggcgttcagcgcgttcggcttcacctcactgaccgcggtcgcgctgaggaaccggctgaacgcggccaccggggcacggctcgccgccacggtggtcttcgaccatccgacccccgccgggctggcacgccatctggtgcgggagatcaccgggaagcgaagcgtgcgggcgccggtgcgggcgcgcggggtgtccgacgagccggtggcgatcgtggcgatgggctgccacctgcccggcgaggtcgcgacgcccgaggacctgtggcggctggtggccgacgggcgggacgcgatcgccgggttcccggaggaccggggctgggacctggccgggctcttcgactccgacccggatgccgtgggcaagtcctacgtccgcgagggcggtttcctcaccggcgcgggcggattcgacgccgccttcttcggcatctcgccccgcgaggcgctggccatggacccgcagcagcggctgctgctggagaccgcgtgggagaccttcgagaacgccggaatcgacccgggttcgctgcacggcaccgacgtcggtgtgttcagcggagtgatgtaccacgattacggggccgacgccgggacggcggcggagggcctggaggggcatctcggcgtgggcagcgcggggagcgtcgtctccggacgcgtggcctacgcgatgggcctgaccgggcccgcggtgacggtggacaccgcctgctcgtcctccctggtggcgctgcacctggcggttcaggcggtgcgtacgggcgaatgctcgctggcgctcgccgggggtgtcgcggtgatgagcaggccgacgtcgttcatcgagttctcccgccagcgcggcctcgcccccgatggccgctgcaagtcgttcgcggagggcgccgacggcaccaactggtccgagggtgtcgggttggtgttgctggagcggctgtccgatgcccgccgcaatgggcatgaggtgctcgccgtggtccgtggcacggcggtgaaccaggacggggcgagcaacggcctgaccgcgcccaacggcccttcccaggaacgggtgatccggcaggcgctggcgaacgccgggctgacggtggccgatgtggacgcggtcgaggcgcacggcaccggcacgagtctcggcgaccccatcgaggcccaggcgctcctggccacctacgggcaggagcggccggagggtcagccgctgtggctggggtcgttgaagtcgaacatcgggcatgcgcaggcggcggcgggcgtggccggtgtcatcaagatggtgctggccatgcggcacaacacgctgccgaaaacgctgcacgcggagcggcccactacgcaggtggactggtcgcagggtgcggtgtcgctgctgtccgaggcccggccctggccggagaccggacacccccgccgcgccggaatctcctccttcggcgtcagcgggacgaatgcccatgtggtcctggagcaggcgccgcctgaggtggccgtgcccgaagcagaggccagcgaggcgggcactcctgggctggtggccacgggcggcgtggtgccgtggatgctgtcgggtaagactcctgcggcgctgcgcgcccaggccgagcgtctggtcagccacctggaatccggggacgctccgcgtgcggtggacgtgggctggtcactggccaccacgcgcgccgccctcgatcatcgcgcggtcatcctcgccacggataccgaggacggcatcgccaccgcccgcgctttggcggagggacggcccgacccgctcctggtcaccgggcagaccgggacagacggcaagaccgtgttcgtcttccccggccagggagcccagtgggtgggcatgggggcacaactcctcaacacctcgcccgtcttcgccacccggctacacgagtgcgccgacgcgctggccccgtataccgactggtcgctcatcgacgtcatcaccggcgcacccgatgccccttcgctcgaccgtgtcgacgtcgtacagcccgccaccttcgccgtcgtcgtctccctcgccaccctctggcaatccatgggtatccaccccgacgccgtcaccggccactcccaaggcgaaatcgccgcagcctgcgtcgccggacacctcaccctcaccaacgccgccaaaatcgtcgccctgcgcagccagatcatcgccgaccacctcgccggacacggcggcatgatgtccctcgccacccccgccgacaccatcgacctcaccaactggcacggcaaactctggatcgccgcacacaacggccccaacgccaccgtcatcgcaggcgacgccgaagccctgcaccaactccacgcccactacaccgaccaaggcacccgagcccgcatcatccccgtcgactacgcctcccacaccggacacgtcgacaccatcaagaacgaactccaccaaaccctggccgacaccaccaccgagcccggcaccctcccctggctctccaccgtcgacggggagtggatcgaacccgacacgctcgacagcggctactggtaccggaacctgcgccaaacggtgcagttccacaccgccatcaccaccctcgccgaccagggctaccgcacctacatcgaaatcagcccccaccccgtcctcaccaccgccatccaagaaaccctcgaaacacacaacacccccaacgcgatcgtcaccggaaccctccgccgcgacgacgacacccccacccgcctcctcaccaacctcgcccacctcaccacccacggaacacccgtcaactggcccaccctcttcaccggcacacaccccacccgcatcaccctccccacctaccccttccaacaccaccactactggctcccccgcaacaccaccacaggcgatgtgagtgccgtgggcctccagggcacgggccacccgctggccggggccgtggtgagcgtgcccgacaccggtggtgtgctgctcaccgggcaactgtcggtggccacccacccctggctggccgaccacgccgtctccggaaccgtcctgctgcccggcgccgcgatggccgaactcgccatccgcgccggagacgagaccgccacccccaccctggaagaactggtcatcggccagccgatgacactgcccgaagacggtgcgctgcacgtccaggcactggtcggcggcgaggaggacgggcgccgaggggtacggatctactcccgccccgacgcggcccaggaacaggaatggctggagcacgcctcgggcacgctcgccacgcagccggacggttcggccgagggtggcagggaagacggcatggccgagtggccgccgcccggtgtcgaaccgatcgctctggatcacttctacgacgacctcgcccaggccgggtacgagtacggccccgcgttccgcgggctgaaggcggtctggaagcgcgatggcgaagtgggcgaggtgttcgcggaggccgcgctgccggaggagcagacggaggccgccggccggttcggcatccacccggcactgctggacgccgcgttgcacgcgagcaacttctgtgtgcccccggtcccgggccagacgctgctccccttcgtgtggaacgacgtacggctgctggcggcgggagccacggccgtccgtgtgcgcgcccgtgccaccggcccggattcgttcacgatcagcctgtacgacagtaccggctcccccgtcgcctcggtggactccctggtgctccgggcgatcagtcccgagcagctcgccgccgcgtccggcggcgccgatcggtccgctgatgcgctgttcacggtggactggaccgagcaccccaccgccctggggaccgaggtctcctggaccaccctcggcgacacccacacccacgccgacgtggacgcagccatggacgcgctcatcgcgggagaggaccgccccggggccgtggtcgccgacaccacggcctgggccgccggggacaccgagctgcccacgcgggccagggacctggccgcccgcgcgctggacctggtgcagcgatggctagcccaacccgaactcgacgacgtccggctggtgttgctcacccgtggggcggtgtccgtacacgacaccgccgaggtcaccgatccggccgccgccgcgatctggggcctggtccgctccgcccagtccgaacacccgggccggatcgccctggtggacaccgacgacgcgtcgcgggaggcgctgcccgaggcggtggcgtccggcgaaccgcaggtggcgctgcgccgtgggctgctgtgggtgccgcgtctggtgcggtcgtcgcagggtctcgccgtacccgcccacgagcactggtacctcgacgtctcggagaagggcagcctggagaacctggtgctgcggccggatccggaggccaccgcgccgctggccaccggtcaggtccggatcgaggtccgcgccgccggtcagaacttccgggacgtgctcgtcgcgctcggcggcgtggcgggtcaggagggtctgggcggcgagggcgccggtgtggtgaccgaggtcgggccgggggtcgagggcctggccgtgggcgaccgggtgatgggtctgttcccgcgctcgttcggcccgctggccaccgcggacgcgcgaacggtcgcgccgatccccgaggggtggtcgtacgccacggccgccggagtgccggtggcctatctgacggcgctgtacggactgcgggacctgggcaatgtgcagccgggtgagacggtgctggtgcacgccgccgcgggcggtgtgggcatggccgccgtccagttggcgcggcacttcggcgccctcgtgtatgccaccgcccatccgtcgaagcaccatgtgctgaccgcgttgggggtgccggaggggcatctggcgtccagccgcgacctcggcttcgcctcggcgtttcccgcgctggacgtggtgctgaactccctcaccggcgagtatgtggacgcctcactggggctgctcggcaccggtggccgcttcgtggagatgggcaagaacgacatccgcgatcccgccgtggtcgccgcggcacatcccggtgtgggctatcaggcgttcgacctgggaggtgacgcggggccggaccggatccgggagttgctcactgagctggtggagctgttcgaggcgggccggatagagccgcttccggtgcggcagtgggacatcacccgcgcccccgaggcgttccgctggatgagccaggggcggcacaccggcaagatcgtgctcaccctcccccgcgccctggacccggacggcaccgtcctgatcaccggcggcaccggaaccctcggcgccaccgtcgcccgccacctcgtcacccagcacggcacacgccgactactgctggtcagccgccggggaccggacgcacccggcgccaccgacctcaccaccgaactcaccgaactcggcgccaccgtccacatcaccgcatgcgacaccgccgaccgcgaccaactcgccaccaccctcgccgacatcccggccgaccaccccctcaccgccgtcatccacacggccgggacgctcgacgacggcaccctcaccgcactcaccccggaccgcctcgacaccgtcttccgccccaaggtcgacgccatcacccacctccaccacctcacccacgaccacgacctggccgccttcgtcatctactcctccgccgccggaacgctcggcaacgcgggccaggccaactacgccgccgccaacgccttcctcgacgccttcgcccagtggcggcacgcccgccatcggcccgccacctcgctggcgtgggggctgtggagcgacaccagcacgctcaccgcgacgatggacgccaccgacgtgcgccgcacacggcgggcgggggtgctgggcatggacaacgccgaggcgctgcgggtgttcgacaccgggttgcggtccgggcggcccgcgctggtggcagcgaagatcgacctcaccgccctgcgcgcgccggacgccgagttgtcgccgctgctgcgcggtcttgcccgcccggcgcgccgcaccgcgcggaccgcggccccggcggccggtggtctgtcggggcagttggccgggctgtcccccgccgggcagcgggagttcctgctcaacctggtgcgggcggaggccgcggtggtcctcggccataccgggcctgaggcgatcgagccgacggtggcgttcaaggagatgggcttcgactcgctgacggcggtcgaactgcgcaaccggctgaatgcggcgaccgggctgcggctccccgccacgttgctcttcgaccacccgaccccggctcttctcaccgagctgttccacaccgagctgggcggcggcccggcacccgccgcggcggccccggtgaccgtgcgcgccgccgctgacgagccgatcgccgtggtggcgatgagctgccgtctgccgggcggagtgaccgacccggacgggctgtggaacctgctgctcggagagcgcgacggcatcaccgacttcccccgtgaccggggctgggacctggaggcgctgttcgacgccgacccggaccggagtggcacctcctatgtgctgcgtggcgggttcctcgaggacgcggccggtttcgacgcggacttcttcggcatctcgccgcgtgaggcgctggcgatggacccgcagcaacggctgttcctggaagcctgctgggaggtgttcgagcgggcgggcatggacccgaccgcggtgggaggcggcgacatcggcgtgttcgccggcgtcatcaaccaggactacggcgtgcggagcggtcccgctcccgaggacctcgagggctatatgctcaccggctcggcgacgagtgtcgcctccggccgggtggcctatgtgctgggcctggagggcccggcggtcacggtggacacggcgtgctcctcctcactggtggccatgcactgggccgtacaggcattgcggcagggcgagtgctcgatggcgctggccgggggcgccacggtgatggggcggccgtcggcgttcgtggagttctcacgccagcgcggcctggcgccggacggcctgtgcaaggcgttcggggcgggtgcggacggcaccaccttcagcgagggtgtcggggtactgctgctggaacggctctcggacgcccgccgcaacggccacgaggtgctggccgtggtccgcggtacggcggtgaaccaggacggcgccagcaacggcctcaccgcccccaacggcccctcccagcagcgcgtgatccgacaggcactggcgaacgccggactgtcggccaccgacatcgacgccgtcgaagcacacggcaccggcaccgccctcggcgaccccatagaagcccaggcactcctggccacctatggccaggaccgtcctggggacgagcccgtatggctcggctcgctgaagtcgaacaccgggcacacgctggccgcggcaggcgtgtccagcgtcatcaagatggtgctggcgatgcggaacggcacgcttccgcgctccctgtacgccgacgagcccacaccggaagtggattggtcccagggcgcggtgtccctgctcaccgaggcccggccctggccggagaccggacacccccgccgcgccggaatctcctccttcggcatcagcggcaccaacgcccacctcatcctggagcaggcccctcagcccgaaccccaggccgagaccgaccccgagcccgaagccgcgccgaaggcggacgacggcatggccactcccgggctcgtggcgaccggcgggagcgtgccctgggtgctgtccgccaagaccgccacggccctgcgggctcaggctcaacggctcctggaccacctggagtccggggtgaccgaccgccccctcgacatcggctggtccctggccaccacccgcaccctccacgaccaccgcgcggtcatcctcaccgacaccgagggcgctgacgccacggccgccctcaccgccctcgcgaccgaacaaccccacccccgcctcaccaccggccacgccaccacccacggcaagaccgtgttcgtgttccccggccagggcgcccaatgggcaggcatgggagcccaactcctcgacacctcacccgtcttcgccacccgcctccacgaatgcgccaaagctctcgccccctacaccgactggtcactcatcgacgtcatcaccggcgcgcctgatgccccttcgctcgaccgcgtcgacgtcctccagcccaccaccttcgccatcatggtctccctcgccgcactctggcaggccaacggcatccaccccgacgccgtcatcggccactcccaaggcgaaatcgccgcagcctgcgtcgccggacacctcaccctcaccaacgccgccaaaatcgtcaccctccgcagccagaccatcgcccaccacctcaccggacacggcgccatgatgtccgtcctcgcatcccccacctgggtccaggaaacactcgcaccctggcacggacacctatggatcgccgccgtcaacggccccgcatccgtctccgtatccggagaccccgacgcactcgccgaattcggcaccaccctctccaaagccaaggtctaccgctggcaactccccggcgtcgacttcgccggacactccggacacgtcgacaccatcaaagaccagttgcacaacgtactcgacggcatcaccgccacacccggccacaccgcctggatgtccaccgtcgacgccgactgggccaaccccacacacatcgaccccgactactggtaccgcaacctccgcgacaccgtccgcttcgaagaagccacccgagccctcctcacccagggctaccgcgtcttcatcgaggtcagcacccacccggtgctgaccaccgccatccaggacaccaccgaatccctccccgatacccccaccaccatcaccggcaccctccgccgcgacgacggcggccccgaccgcgtcctcaccagcctcgcggagctctccgccgccggaattccggtccactggcccaccgcgtacgccggaaccacaccctcccaagttccgctgcccacctaccccttccagcaccagcactactggctggccgccaccggccaccacggggatgtcggctccgtgggactgcgcgacgcggcgcacccgctgctgggggccgtggtcagcgtgccggacaccggaggggtgctgctcaccgggcggctggcaccgtcggcgcagtcctggctggccgaccatatgctgtccggcgtcgccctggtgccgggtacggcgatcgtggaactggccgtacgggccggggacgagaccggcacaccggtgttggaggagctggtcctcggccagccgatgcttctccccgaggacggctcgcttcaggtgcaggtcctggtcggcgcggccgaggacgatgagcgccgtacggtgcgggtctactcccgcggcgacgagtccgagccctgggtcgagcacgcctccggcatcctgtccgcgcaggcgctcatacctgtcgaggcggagcggcagtggccgcccgccggggcggaacccgttgccctggagggcttctacgaccgcttggccgaggcaggctatgagtacggtccggtgttccgcggtctcaccgcggcgtggacgcgcgacggtgatgtgttcgccgaggtcaccctcggcgaggagcagcatgacctcgcgcgccgcttcggcatccatccggcgttgctggacgcggcgctgcacgcgagcaacttctgcccgggcaacgagcccggcggcgggacgtatctgccgttctcctggaacggtgtgcagttgcacgccgacggcgccaccgccctacgagtgcgggtcacctccaccgggccggacaacctgtccctgtacgcgaccgatccgcacggggtgcccgtggtgaccgtcgggtcgctggtgctcagggagaccaccgcggagcagctccgcaccacatcggcctcgtccaccgcggattcccagttcaccgtggagtggaccgaacatgccctggcccgggacgaggtggcgtgggcggcgctggacgccgtgcccgaccaggacacgtggccgccggtggtcgtcgccgacacccgggcatacaccgcggagggcggcgaactaccggagcgcgcccgtgcgctgacctgccgggcactggccgcgatacggcgtctgatcagcgacgacgcactcgccgacagccgtctggtgctgctcacccggggtggcatggcggtgcatgacgacaccgaggtcaccgacccggccgccgccgcggtgtggggcctggtgcgcgccgcgcaggccgagcacccgggccgggtgtgcgtgatcgacaccgacgaccggtcggccgaggccctgcccgccgcgctggccacggaggaaccccagctcgcgctgcgtggcggaatcgcgtgggtgccccgcctggtgcgagcgcgcccgggcctggcggtcccggccaccgcggcgtggcatctggacgtcaccgaacacggcacactggagaacctcgccctggtgccccaccctcgggcggaggcgccgctggaggcgggccaggtgcggatcgcggtacgcgccgccggtcagaacttccgcgatgtgctcatcgccctcggcatgtacgaggcggagatcggcaccgagggcgcgggcgtggtgaccgaggtcggcccgggcgtggcggatctggccgtgggcgaccgtgtgatgggcatgctgcccggttcgttcgggccgctggtggtggcggaccggcggacggtggtgcggatgccgcgcggctggtcgttcacggcggcggccggggtgccggtcgcctatctcaccgcgctgtacgcgttgcgggatctgggcgatgtccagccgggcgagacggtgctggtgcacgccgcagccggtggagtcggcatggccgccgtacacctcgcccaccacttcggcgccaccgtcctcgccaccgcccacccggccaaacaccacagcctggaacagctcggggtggccacggaacggcgcgcctccagccgcgacctcgcctacgcccacaccttcccgaccaccgatatcgtcctcaactccctcaccggcgaacacatcgacgcctcgctgcggttgctcaaccccggtggccgtttcatcgagatgggacgtaccgacatccgggacgtggacgaggtggccgcgacgcacccggaccgcacctatcgcgcgttcgacctgggcgcggacgcggggccggatcgcatccaggaactgctggtcgagctggtggacctgttcgagcagggcctgatccctccgttgcccacccggccgtgggagatcacccgcgcccccgacgcgttccgctggatgagccagggccgccacaccggcaagatcgtgctcactctcccgcgcacccccgaccccgacggcaccgtactgatcaccggcggcaccggcaccctcggcactgccatcgcccgtcacctcgtcacccaccacggtgtacgcaacctggtcctcaccggccgccaggggccgaacgcccccggcgcggccgaccttcacgacgaactgaccgcactgggcgcacaagtacggatcaccgcctgcgacagcgccgaccgcggccaactcgccgcactcctcgccggcatcccgtccgaccaccccctcaccggcatcgtgcacaccgccggcaccctcgccgacggcaccctcaccacactcgaccccgaccgcatcgacaccgtcttccgccccaaggtcgacgcggtcacccacctgcacgacctcacccgcgaccaggacctggccctcttcgccgtgtactcctccgccgccggaatcctcgggaacgcgggccaggccaactacgccgccgccaacaccttcctcgacgccttcgtacagcagcggcgcgcggcggggctggccgggctgtcgctggcctggggcctgtgggcggagaccagcgagctgtcggccgcgctgatcacggccaaccgggatcgcacccgacacggtgtcgtccgcccgatgaccaccgagcacgccctgagcctcttcgactccgccctcggcctggggctgcccctggtggtaccggcgaagctggaccccggcgcacacgagtccgccgcgggcgctgtgtcgccgctgctcaccgggctcgtccggccgacccgacgcaccctgcggtccacgtcgggccaatccggcgaaggcggtctgacggcccggctggcggcgctgtccgaggccgatcagcaccggctactgctggacctggtacgggaccatacggcgaccgtgctcgggcacaccgggaaggacgccgtggacgccaggcgcgcgttcagcgacatcggggtcgactcgctcatcgcggtggaactgcgcaaccggctcgccggcgcgaccgggctgcggctgcccgcgacggtcgtgttcgactacgcgacaccggaggcgatggccggacatctgcggtccgtggtggccggagacacggccgcccccgcctccccgtcgacgtcggcgcccgcttcggcggtggccccggcggacgacccggtggccatcgtgtcgatgaactgccgactgcccggcaaggtcaccggcccaggggaactgtgggatctggtgtcccagggccgggacgcgatcggccccttccccacggaccgcggctgggacgtggagacgctgttcgacctcgacccggacgccgtgggcaagtcctacgtacgcgagggcggtttcctcaccggcgccggtgacttcgacgccgagttcttcggcatctcgccacgcgaggcgctggcgatggatccgcagcagcgactgctcgccgagacctcatgggagctgttcgagcaggcgggcatcgacccgatgtccgtgcgcggacaggccatcggggtgttcgccggggtcatcgaccagggatacatcgcccactccgaggcgcccccgccggagttggagggctacctgatgaccggcagcaccacaagtgtggcctccggccgagtggcctatctgctgggcctcgaaggccccgcggtgacggtggacacggcgtgctcgtcgtcgctggtggcgctgcatctggccgtacaggcgctgcgggcgggcgagtgctcgatggccatcaccggtggcgtgacggtgatcgccaagcccggcggtttcatcagcttctcccgccagcgcgggctcgcgccggacggccgtagcaagtccttcagcgagggcgccgacggcaccaccttcagcgagggcatcggtctggtgctgctggaacggctctcggacgcccgccgcaacggccatgaggtactggccgtgatccgtggcaccgcggtgaaccaggacggggcgagcaacggcctcaccgctccgaacgggccctcccagcagcgagtgatccggcaggccctgtccaacgccgggctcacagtggccgacgtggacgcgatcgaggcacacggcaccggcaccgccctcggcgaccccatcgaggcacaggcactgctcgccacctacggccaggaccgcccgggggacgaacccgtgtggctcggctcgctgaagtccaacatcggccacacgcaggccgccgcgggcatcgcgggcctcatcaagatggtgctggcgatgcggcatggcatgcttccgccctcactgcacgccggcgagcccaccaccaaggtcgactgggcgtcgggggcggtgtccctgctgtccgaggcccgaccctggccggagacgggacaccctcgccgcgccggaatctcgtccttcggcatcagcgggacgaacgcacacgtgatcctggagcaggggccggaggtggctgtgcccgaggcggagacgggcgctcctgggttggtggccacaggcggtgtggtgccgtgggtgctgtccgccaagagccctgcggggctgcgggctcaggccgagcgtctggtcagccacctggaatccggggacgctccgcgtgcggtggacgtgggctggtcactggccaccacgcgcgctgccctcgatcatcgcgcggtcatcctcgccacggataccgagcagggcacggcgaccgtccgtgccctggcggagggacggcccgacccgctcctggtcaccgggcagaccgggacggatggcaagaccgtgttcgtcttccccggccagggagcccagtgggtgggcatgggggcacaactcctcagcacctctcccgccttcgccacccggctacgcgagtgtgccgacgcgctggccccgtataccgactggtcgctcatcgacgtcatcaccggcgcacccgatgccccttcgctcgaccgtgtcgacgtcgtacagcccgccaccttcgccgtcgtcgtctccctcgccaccctctggcaatccatgggtatccaccccgacgccgtcaccggccactcccaaggcgaaatcgccgcagcctgcgtcgccggacacctcaccctcgacgccgccgccaaaatcgtcgccctgcgcagccagatcatcgccgaccacctcgccggacacggcggcatgatgtccgtcctcgcctcgcgggaacaggtcgaggaagccctcaccccgtggcagggcaagctctggatcgccgcgcacaacagcccccaggcgaccgtcgtcgcaggcgacatcgacgctctgcacgaactccacgcccactacaccgaccaggacatccgagcccgcatcatccccgtcgactacgcctcccacaccggacacgtcgacaccatcaagaacgaactccaccaaaccctggccgacaccaccaccgagcccggcaccctcccctggctctccaccgtcgacggggagtggatcgaacccgacacgctcgacagcggctactggtaccggaacctgcgccaaacggtgcagttccacaccgccatcaccaccctcgccgaccagggctaccgcacctacatcgaaatcagcccccaccccgtcctcaccaccgccatccaagaaaccctcgaagccaacgacacctccaacaccaccatcaccggaaccctccgccgcgacgacgacacccccacccgcctcctcaccaacctcgcccacctcaccaccaacggccacacccccgactggacagccctctactccgccacccacccccaccccacgcccctccccacctaccccttccaacaccaccactactggctcacaccgtccgaggtgccggaggcggtggccgacggtgtgttctgggagaccgtggagcggggcgacctcgcctccctggccgattccctcggcgtcgaggagaaggcgctggagcccgtcctgccggggctgacgtcgtggcggcgccgcaaccaggaccagtccaccgtggacgcctggtcgtatcgcatcgcctgggatccggtggccagcggggaggcgcccgtactgccaggagcgtggctggtggccgtggcctcaccgcagacgagcgacaccgcggtgacgggcgtgatcgccgcgctggccgcgcacggcgccgatcccgtggtggtcgaggtggacacggtggagcgggcggaggtgaccgccctcctgcgggagcggatgtcgggttccgatgacgagtacgccggggtgctgtccctgctggcatgggacgagcggacctgcgaacccggcacgctctcccggggcgtggcggccaccgtggcgctgatgcaggccgtggaggagatcgggctcaccgctcccctgtggtgcctgacgcgtggcgcggtcgccgtgcgtgaaccctccgaggtgaccagcgagttccagccgctggcctggggaatgggcgtggtgcaggggctggatcagccgtccacctggggtgggatcgtggatctgccgcggacgccggatgatacggcccttgcccggttgtgctcggtgcttgccggagtggacgcggaggaccaggtcgcggtgcgcgcgtcgggggtgttcgcccggcggatgcggcgcgaaccggtgacgtcggcaccggcgtggcagccacgggacacggtgctgatcaccggcggcaccggcggactcggctcgtacgtggcccgttgggccgcgggtcacggcgcccggcgtgtggtgctgctcagccgtcagggtgcgcaggcggcgggcgcggcggagctggaggccgagctgaccgcgctgggcgcggacgtgaccatcgcggcgtgtgatgtgaccgaccgggaccagctcgcggccgtcctggcggagattccggatgacgtgccgttgtcggccgtggtccacgccgcggggctggcgctgccggagaagccgctgtcgaagatgacactcgccgagttcgccgatatcggccgggcgaagatcgccggtgcgcggcacctcgacgatctgctgggggaacgggagttggacgccttcgtcctgttctcgtccggagcggcggcctggggcagcggcggccagagcgcctacgccgccggcaacgcctatctcgacgggctggcgcagcgccgccgcgcacgggggctggcggccacgtcggtggcgtggggcgcctggggtggcggccttggcacgatcgacgaggcgatgggcgcgcagtggcgccgtacgggtctgatgaccatggacccgcggctggcggcgctggcgatggcgcacaccgtgggcagcggcaccgcccacggggtggtggccgacatcgactgggaacggttcgcccccggctacaccctggcccggttccggccgctgctgcggggactgcccgatgtcatcgacctgctgaccgaggacacacacgaggacggcgcgggacagacggagctgatcgcacggctggccgggctgagccccggggaccaggagcggctgctcaccgagctggtgcaggccgaggccgcggccgtactcggacacgcgagcgccgatgccaccggggaccgtccgttcagcgagatcggattcgactcgctgacggcggtggagctgcgcaatcgcctcaatgccggcacggggctgaagctgcccgcgacgatggtgttcgaccacccgcggcccagtgcgctggcgcgccgtatccgcaccgaactcggccagaccgacacctcgtcggtggactcggtgctggccgagctggagcggctggaagcacatttggcggcgctgccgaaggagaagatcgaacgcgcccggatcacctcgcggctacagcggatgaccaccaaggtcgccgagatcgaggccaacggcgcgggcggcgaaaccgtcaccgaacgactcgacacggcgaacgccgacgacgtgttcgccttcatcgaccaggagttcggcgtggactgattccccgtctcgtctccgctcaccgatttcacccacgaggctcttggcgaggtccagatggcgaatgacgaaaagctcctcaactacctcaagcgggttaccgccgacctgcaccagacgcgggaacggttgcgcaaggccgaggcggcgacggaggagccgatcgccatcgtcggcatgggctgccgcttcccgggcggcgtgaccaccccaaacgggctgtgggatctggtggccgacggccgggacgcgatcgccgggtttccggaggaccgcggctggaacctggagaacctcttccacgccgaccctgactccgtcggcacctcctatgtgcgcgagggcggtttcctcgccgacgcggcggagttcgacgccgagttcttcggcatctccccgcgtgaggcgctggccaccgacccgcagcagcggctgctgctggagaccgcgtgggagaccctcgagcacgcgggaatcgacccgagttcgctggcggacagcgacgtcggcgtgttcaccggcctggccaacggtgactacgcgctgaccgtggaccaggtgccggaggggttcgagggatatctgggtctcggtggcgcgggcagcatcgcgtccggccgcatctcgtactcgctcggtctgctcggcccggcggtcactctggacaccgggtgctcctcgtccctcgtggcgatgcacttggccagttatgcgctccggtccggggagtgctccatggcgctcgccggtggcgtgatggtgatggccacccccggcggcttcgtcggattctcccggcagcgggggctggcgcgcgacgggcgctgcaagtccttcggtgagggcgcggatggcaccaactggtccgagggcgccggtcttgtgctgctggaacgactgtccgatgcccgccgccatgggcatgaggtgctcgcggtcatccgtggcaccgccgtcaatcaggacggcgcttccaacggcatcaccgcgcccaacggcccgtcccaggaacgggtgatccgccaggcactggcgaacgccgggctgacggtggccgatgtggacgcggtcgaggcgcacggcaccggcacgagtctcggcgaccccatcgaggcccaggcgctcctggccacctacggccagaaccgcccggaggatcagccgctgtggctgggctccatcaagtccaacatcggccatacccaggccgccgcgggtgtcgcgggcgtcatcaagatggtgcaggccatgcggcatggcgtactgcccaagacactccacgccgacgagcccaccaccaaggtggactggtcgcagggtgcggtgtcgctgctgtccgaggcccggccctggccggagaccggacacccccgccgcgccggaatctcctccttcggcgtcagcgggacgaatgcccatgtgatcctggagcaggcgccgcctgaggtggccgtgcccgaagcagaggccagcgagacgggcactcctgggctggtggccacgggcggcgtggtgccgtggatgctgtcgggtaagactcctgcggcgctgcgggctcaggccgagcgtctggtcagccacctggagtccgggagcgacgccaacccggtcgatgtgggctggtcgctggccaccacccgggcggctctggatcaccgcgcggtcatcctcgccacggataccgaggacggcatcgccaccgcccgcgctttggcggagggacggcccgacccgctcctggtcaccgggcagaccggaacagacggcaagaccgtgttcgtcttccccggccagggagcccagtgggtgggcatgggggcacaactcctcaacacctcccccgccttcgccacccggctacgcgagtgtgccgacgcgctggccccgtataccgactggtcgctcatcgacgtcatcaccggcgcacccgatgccccttcgctcgaccgtgtcgacgtcgtacagcccgccaccttcgccgtcgtcgtctccctcgccaccctctggcaatccatgggtatccaccccgacgccgtcaccggccactcccaaggcgaaatcgccgcagcctgcgtcgccggacacctcaccctcaccaacgccgccaaaatcgtcgccctgcgcagccagatcatcgccgaccacctcgccggacacggcggcatgatgtccgtcctcgcctcgcgggaacaggtcgaggaagccctcaccccgtggcagggcaagctctggatcgccgcgcacaacagcccccaggcgaccgtcgtcgcaggcgacatcgacgctctgcacgaactccacgcccactacaccgaccaggacatccgagcccgcatcatccccgtcgactacgcctcccacaccggacacgtcgacaccatcaagaacgaactccaccaaaccctggccgacaccaccaccgagcccggcaccctcccctggctctccaccgtcgacggggagtggatcgaacccgacacgctcgacagcggctactggtaccggaacctgcgccaaacggtgcagttccacaccgccatcaccaccctcgccgaccagggctaccgcacctacatcgaaatcagcccccaccccgtcctcaccaccgccatccaagaaaccctcgaagccaacgacacctccaacaccaccatcaccggaaccctccgccgcgacgacgacacccccacccgcctcctcaccaacctcgcccacctcaccacccacggaacacccgtcaactggcccaccctcttcaccggcacacaccccacccgcatcaccctccccacctaccccttccaacaccaccactactggctcccccgcaacaccagcacaggcgacatcgcctcagccggtctccacgaccccgcgcacccgcttctcaccgccgccgtccacctccccgacaccggtggcaccgtcctcaccgggcggctctccctgaccacccacccctggctggccgaccacaccgtgtccggtgccgtcctcctccccggcgccgcgatggccgaactcgccatccgggccggagacgagaccgccacccccaccctggatgagctggtcatcgagcagccactggcgctaccggacagtggcttcctggacatccgggtggtcgtgggcggccctgacgaggccgggcgtcgggacgtacgcatctactcccgcgccgcagaagaatcagcgcagtggacggtgcacgccaccggcacgctggcccaggacaccacggctcctccgtcgcccaccgccgccgaatggccacccgccggtgccgagccggtggccgtcgagggcctgtacgagcagatggccgaggggggctacgactacggaccgacgttccagggcctgaaggcggtatggacccgcgacggcgacgtgggcgaggtgttcgcggaggccgcgctgccggaggagcagacggaggccgccggccggttcggcatccacccggcactgctggacgccgcgttgcacgcgagcaactactgcctgcccggggagcccggcggccgtatgctgctgccgttcgcgtggaacgacatacgcctgcacgccaccggtgccacttcggtgcgcgtacacgcccgttacaccgaggacgacggcctctccgaggtcctggtcgacacggccggagggctggtcgcgtcgatcggttcgctggttctgcgggaggtcgacgcggcgcagctcgaagcgctggcctccacctcggtgaacgacgcgctgtggacggtcacttggaccgaacacaccgccaccacggacgagatccggtggggcaccctaggggacgtctcacccgtcctcgccgccgccgaagccccggccttcgccgatgtcacagagatcgccaccgcgcccgccacggagatcgccgggaccgaggaccggcccgcgctgatcgtcgccgacacgacagcatggcagtcgcgggacgccgaccccatcacgcgggcgcgcgaactggccacgcgggcgctggacctgttgcagcggtgggtgacgctgcctgagctgtcggaaacacggctggcggtcctcacccgcggtgcgatggccgtacacgactcggccgaggtcaccgactccgccgcggcggcgatctggggtctggtccgctcggcccagtccgaacaccccggccgcatccagctcatcgacgccgacggccactcggaccacacactgcgcagcgcactgtccaccgcactcaccaccgaccagccccaactggccctccgcgacaacacgctctgggcgccccggctcaccccgacaacacccgccgacacacccgcccagccgctccctctcaaccccgagggcaccgttctcgtcaccggcggcaccggcaccctcggcgctctcaccgcccgccatctcatcacccaccacggcgcccggcacctgctcctgatcagccgccaggggcccgacgcccccggcgccaccgacctcaccaccgaactcaccgaactcggcgccaccgtccacatcaccgcatgcgacaccgccgaccgcgaccaactcgccaccaccctcgccgacatcccggccgaccaccccctcaccgccgtcatccacaccgccggaaccctcgacgacggcaccctcaccgcactcaccccgaaccgcctcgacaccgtcttccgccccaaggtcgacgccatcacccacctccaccacctcacccacgaccacgacctggccgccttcgtcatctactcctccgccaccggcaccctcggcacccccggtcaggccaactacgccgccgccaacacctacgccgacgccctcgtccaccaacgccacgccgccgggctccccgccacctccctcgcctgggggctatgggaaaccaccagcgccctcaccgccaccatgaacaccgaggaccgccgacgcacccaccgtggcggtgtggccgccctgaccgacgacgaggggctcgccctcctcgatagggccctcaccgccacccaccacccccacctcgtcccgatcaagatcagcccggcctcccttcgggccgatgacacggcgcagcccgttccgccgctgctccgccacctcgtacggcgccccacgcgccgtacggcccacacaccggcccccgccgacaccctgtcgctcgcccaacggctcgccgccctcgaccagggcgaacggctacggcacctcacggagctcgtccgcaccgaggcggcggccgtactcggacatacgacgatcgacagcatcgggccggaccagcccttccgcgacgtcgggttcgactccctcacggcggtggaactgcgcaaccgcctcaatgcggccacgggactgcggctccccgcgaccgtggtgttcgactacccgaccccggcgatcacggccgggtatctgcgggacgagctgttcggcccggcggaggcggccccggccgccgtcgccgggccgggggccgacgcggacgatcccgtggtcgtcgtcggcatggcctgccggctccccggacgggtgaccgacccggacgggctgtggcggctggtggccgacggggaggacggcatcggggcgttccccaccgaccgcggttgggatctggacacgctcttcgaccccgacccggaccgggtgggcgcgacctacgtccgcgagggcgggttcgtggcgggggccaccgagttcgacgcggacttcttcggcatctccccgcgtgaggccgtggcgatggacccgcagcaacggctgctgctggagaccgcgtgggagaccttcgagcaggccggtatcgccccacggtcggtgcagggcagcgacaccggtgtgttcgccggggtcatctaccacgactacgggacgaacgccggtgagctgcccgagggctcggagacctatctgagcacgggcaaatcggggagcgtggtgtccgggcgggtggcctacgcgctgggcctgaccggtcccgcggtgacggtcgacacggcgtgctcctcctcgctggtggccatccactgggcggccaaggcggtgcgggagggcgagtgctcgatggccctggccgggggcgtgacggtgatgtcgaccccggatgggttcgtgagcttctcgcaccagcgcgggctcgcccccgacggccgcagcaagtccttcggcgagggcgccgacggcaccaccttcagcgagggcgtcgggctcgtgctgctggagcggctctccgaggcgcggcgcaacggtcacgaggtgctggccgtggtccgcggtacggcggtcaaccaggacggcgccagcaacggcctcaccgcccccaacggcccctcccagcaacgggtgatccgccaggccctgtccagtgccggactgtcggcgaccgacatcgacgccgtcgaagcccacggcaccggcaccgccctcggcgaccccatagaagcacaagcgctgctggccacctacggccaggaccgccccgccgaccagcccctctggctgggctcactgaagtccaacatcggccacacccaggccgccgcgggcatcgcgggcgtcatcaagatgatccaggccatgcggcacggcatgctgcccaggacactccacgccgacgagcccaccaccaaggtcgactggacgtcgggcgcggtgtccctgctcaccgaggccaggccctggccggagaccggacacccccgccgcgccggaatctcctccttcggcgtcagcggcaccaacgcccatctcatcctcgaacaggccccggaggaggcggccaccgcaccagagaccacggagccggaggctcccgggctggtggccacgggcggcgcggtgccgtgggtgctgtccgccaagagcccaacggccctgcgggcgcaggccgaacgcctgatcgcccaccttcacgcccaccccgagaccgacccggtggacatgggctggtcgctggccaccagccgcgccgccctggaacaccgggcggtcgtcctcgccaccgatctcgaccaggcgaccgccgccctcaccgccctcagcgaagggcagccgcaccccagcctgatcaccggggagaccggcagtgatggcaagaccgtgttcgtgttccccggccagggcgcccaatgggcaggcatgggagcccaactcctcgacacctcacccgtcttcgccacccgcctccacgaatgcgccgaagctctcgccccctacaccgactggtcactcatcgacgtcatcaccggcgcgcctgatgccccttcgctcgaccgcgtcgacgtcctccagcccaccaccttcgccatcatggtctccctcgccgcactctggcaggccaacggcatccaccccgacgccgtcatcggccactcccaaggcgaaatcgccgcagcctgcgtcgccggacacctcaccctcaccaacgccgccaaaatcgtcaccctccgcagccagaccatcgcccaccacctcaccggacacggcgccatgatgtccgtcctcgcatcccccacctgggtccaggaaacactcgcaccctggcacggacacctatggatcgccgccgtcaacggccccgcatccgtctccgtatccggagaccccgacgcactcgccgaattcggcaccaccctctccaaagccaaggtctaccgctggcaactccccggcgtcgacttcgccggacactccggacacgtcgacaccatcaaagaccagttgcacaacgtactcgacggcatcaccgccacacccggccacaccgcctggatgtccaccgtcgacgccgactgggccaaccccacacacatcgaccccgactactggtaccgcaacctccgcgacaccgtccgcttcgaagaagccacccgagccctcctcacccacggccaccgcgtcttcatcgaagtcagcacccaccccgtcctgaccaccgccatccaagagaccaccgaaaccctccccgaagtccgggccaccatcaccgggacgctgcgccgcgacgacggcgccgcggaccgcgttctcgcggggctgggcgggctgttcgcggccggggtgccggtggactggggcgctctgttcgccggtaccggggcccgccgggtgccgctgcccacgtacgccttccagcaccggcactactggctggagcccgccaggaccccgacgcgggccgagaccgccgacggctccctgtgggcggccatcgaggacggcgacacgcagtccctcgcacgggatctcgaggtggacgcggcggccctcggcacggtgctgcccgcgctggcctcatggcgtcggcgcagccgggaggattccctcacggacgcatggcggtaccggatcggctggacccgggtggccgcggccgatccacagatgtcgggccggtggctggtgctggtcccggccgtgcgggcgggctcggcgcgggtccgagcggtgctggacgggctggccgcgcggggcgccgaggtggtggccgccgaggtctccgagaccggccgggaggcgctgggcgaccaggtcaagtcggcggacggcggtgccggggtggtgtccctgctctcgtgggacgaccgcgccgacaccgagtacggcaccgtgtccacgggcaccgcggccacgctcgcggcggcgcaggcgttgcgggaccacggcatcaccgccccgctgtggtgcgtcaccagtggcggggtcgcggtggccggtgagacggccgacccggtgcagtcggcggtgtggggattcggcgccgtgctcgggctcgaccacccggacaccttcggcggcctgatcgacctgccggccgaaagggagggtgacggcgaggcgctgccggacgggctgttcgcggcgctgtcgtctccggagggggaggaccagctcgcggtgcgcgccgacgggctgttcgcacgccggatggtgcgcgaccgggacggctccggcagcctctggaagccacgcggcaccgtgctggtcacgggcggcaccggcgggctcggctcgcatgtggcgcgctggctcgccacgagcggggcggaccatgtggtgctgctcagcaggcagggcggtgacgcgccgggcgcggccgaactggtggcggacctggcgggggtgcaggtcacgctcgccgcctgtgatgtgaccgaccgggaggccgtggccgcggtgctggcggaggcggagcggacccatccgctgaccgcggtggtgcacaccgccggtgccgggctgccctcggctccggtcaccgaggtgaccgccgaggagttcgccgccgtgacgggggcgaaggtgcgcggggcgctggtgctggaccagctcgtcggcgatcggcagctcgacgcgttcgtgctgttctcctccggcgccggtgtctggggcagtggcgggcaggccccgtacgcggcgggcaacgccttcctggacgggctggcggcccggcggcgggcccacgggctggcggccacatcggtggcgtggggcggctggggcggcgggctcggcatgatcgacgccgacggcggcgatcagtggcgccgtatcggcatcctgccgatggatccggcgcccgcgttgcgtgcgatggcgcgggcagtgggcagtggtctgccgaatgcgattgtcgcggacgtcgactgggcgcggttcgtgccgggatacacgatggcccgggagcggccgctgctgcggcagttgcccgaggtcgccgagatcctggcggcggacgcgcggggcgggggcgcatcgcggcgggaggtgcttctgggcagcctggccgagctgaccggcccggagcaggaggtgttcctgaccgatctggtgcggcgtgaggcggcggccgtgctcgggcatgcggacggggacgcggtggagccggagcgtgcgttcaaggacaccgggttcgactcgctgaccgcggtggagctgcgcaaccggatcaacgcggccaccgggctccagctctcccccacggtggtgttcgactatccgaagccgaccacgctggcgaggaggctgcgtacggagctggtccccgccgtgaatggggacgcgaacgggggcatggacggggacgggaccgcggatggcggggccgtcggcgcggagggccgcgagcggcagatccggcgggtgctggcctcggtgccgttacgccgcttccacgagctgggggtgctggacgcgctggtgcgcctcgcggactccgcggccggtgacccgagcggtctgcgcgacctgggcgacctggacaccgccgcggaggcggagacctccgcgctcgcggagctggatgccgacgagctggtgagccgggcgatgcgcggcacgaccttcggaaaccactgacgccgcggttgcggagaggagtacatatggctgcgtcccgggaagacctggtcaaggcgctgcgtacctcgctgatggacgccgagcggctgaggcgggagaacgaccggctgatcgccgagtccaccgaaccggtggcgatcgtggcgatggcgtgccggctgccgggcggggtgaccgacccggagtcgctgtggaagctggtggacgaggggcgggacgcgatcgggccgttccccacggatcgcggctgggacctggagacgctgttcgacgccgatccggacgccgtgggcaagtcctacgtacgcgaggcgggatttctggagggggcgggcgggttcgacgccgcgttcttcggcatctcgccgcgcgaggccctgtcgctggacccgcagcagcggctgctgctggagaccgcgtgggagaccttcgagcgggcggggatggatccgcggtcggtggagggccgggacatcgcggtgttcgccgggggcagcggccaggggtacggcggcggtccgggtgacgcgcccaagggcctggagggttatctgggggtcggggcttccggcagtgtcatctccgggcgtgtgtcgtacacgctcgggctgaccgggcccgccgtcaccgtggacaccgcctgctcgtcctcgctggtggccgcccatctcgccgtacaggccctgcggtcgggcgaatgctccatggcgctggccggtggtgtcgccgtgatgggccagcccaccgccttcgtcgagttctcccggcagcgtggcctggcgcccgacgggcgctgcaagtccttcggcgagggcgccgacggcaccacctggtccgaaggtgtcgggctcgtgttgctggagcggctgtccgacgcccgccgcaacggccacgacgtgctggccgtgatccggggcaccgcggtcaaccaggacggcgcctccaatggcctcaccgcgcccaacggcccctcccaggagcgggtgatccggcaggccctgtccaacgccgggctgacggtggccgacgtggacgcggtcgaggctcacggcaccggcaccgccctcggcgaccccatcgaagcccaggccgttctcgccacctacggccggaaacgccccgccgaccagcccctctggctcggctccctcaagtccaacatcggccacgcacaggccgccgcgggcatcgccagtgtcatcaagaccgtcatggccttacgccacggccggctgccgaagaccctccacgccgaacagcccacctcccaggtgaactggacgtcgggcgcggtgtccctgctcaccgaggcgcgggcgtggccggagaccggacacgcccgccgcgccgggatctcctccttcggcgtcagcggaacgaacgcccacgtcatcctggaacaggcccccgaggaagccgaggcgaccggggagaacacggccggtcaggaaccgtccgtacgctcggcggagtccgccgaccccggtccggtggccaccggccaggtggtgccgtgggtgctctcgggccatacgcgggaggcgctgcgtgcccaggccgcccggctgctgacccaggtacgggagacgcccgccgacggcctccgggacgtgggctggtcactggccaccacccggacccggctggaccaccgcgcggtcgtgctgtgcgccgatgccgagcaggccgtcgcggggctggaggcggtggcctcgggcgcgtccgcccggtcggcggtcagcgggtccgtggccgccggaaaggtggcggtgctgttcaccgggcagggcagccagcgagccggaatgggccgtgaactgcacggcggctacccggtgttcgcgcgggccttcgacgccgtgtgcgcccagttcggcgacctgcccgacggggacgacaaggtctcgctcgccgaagtggtcttcgccgaggaggggtcggcgagggcagcgctgctggaccggaccgagttcacccagcccgcgctgttcgcgctggaagtggcgctgttccggctcgtggagtcgtggggagtgcgccccgcgtatgtgctgggccactcgatcggcgaagtggccgcggcccatgtggccggggtcctgtccctgccggacgcctgcacattggtacgggcgcgcgggcggctgatgcagcgactcaccgcgaccggggcgatggtcgcggtggaggcggccgaggacgaggtggcgccgctgctcgcggggaaggagcacaaggtctccatcgccgcggtcaacggcccgacctccgtggtcgtctccggtgacgaggacgtggtcacggcggtggcggagacgctggcgcggcagggccgcaagaccaagcggctcgtggtctcgcacgccttccactccccgcacatggacgggatgctggacgcgttccgcgaggtggcgtcccggctgacctacgcgccgccacggatacccgtggtgtcgaacctcaccggcacggtcgccgaacccggggagctgtgctcccccgagtactgggtacggcatgcgcggggcgcggtgcggttcctcgacggtgtccgcacactggccgatcagggcgtgcgcacccatctggaactcggcccggacggggtgctgaccgcgatggggcaggactgtctgcccgaggcggacgcggcgttcgtgccgtccctgcgtccgggtgtccaggagccccacgcggtgctggccgggctcgccgggctgtacgtacggggtgtacgggtggactgggacgcgatgttcgccgggtccggcgcccggcgcgtcgcccttcccacgtacgccttccagcacgagcactactggctggagcgggccgccggatccggtgacgtgggcgcggtggggctcggggaggcgggccatccgctgctgggcgcggtggtgcagctcccggagacgggcggggtgcagctcagcgggcggctgtcggtacgggcccagccctggctgggcgaacacgtcatctccggggcggtgctggtgcccggcacggccatggtggaactggccgtccgcgccggggacgagaccggcaccccggtgctggaggagctggtgatcgggcagccgatggtgctgcccggcgacaccgccctgagcgtccaggtcgtcgtgggcgcggacgagggcgggcggcgtacggtgcggatctactcccgtaccgacgggggcagcgactggaccgagcacgccaccggcacactcgcggcgcagggcccggcaccgctggacgggggcgcgtacggagccggggacggggccgccgtccagtggccgcccgcggaagccgagccgatcccggtggaggacttctaccgctcgctcgtcgacgccggatacgcgtacggtccggcgttccgtgggctcgtcgccgcgtggcgccgggacggtgagatcttcggcgatgtggcgctgccggaggcgtccgtcgcggaggccgaacggttcggcatccacccggcgctgctggacgccgcgctgcacgcgggcagcttctgcctgccctcggacccggcgcgacaggtgaccttgctgccgttcgcctggaacaacgtgcgtctgcacgcgggcggcgcgtccgcggtccgggtgcatgtccgcccggtcggcgacgacgccttctcggtacgtctgaccgacggctcgggccagacggtggcctccgtggactcgctcaccctgcgcgcggtggatccggcccaactggagatcggtacggccgacgacgcgctgtggacggtccgttggagcgagacctccctgccggacggcgcgatctcctgggccgcgctgggcgatccggccaccggtggcgccggggccatgggagacaccggaagcgcgggaggcgcccttcccgacgtcctcgtggccgatacgcgcgcctgggccgaagacctcaccgggccgccgaccgcgcgggcccgccggctcaccggccgcctgctggcggagatccagcggtgggtcgccgacgacgcgatggccgggacccggctggccgtggtcacccgcggtgcggtcgcggtgcgcgacgacgccgaggtcaccgacccggccgccaccgcggtctggggcctggtccgctcggcccaggccgaacacccggggcgggtggccctggtggatgccgacggggtgtgcgaggagctgcccgccggggtgtggtccggggaggagccccaactggcggtgcgcggtggcgccgtgtgggtgccgcgcctggcccgggtcgagcccggtctgcgcgtgcccgcgcaggcgtcgtggcatctggactcggccgagtacggcactctggaccatctggcgctgctgcccgacgaggccgagcccgcaccgctggaagcgggtcaggtgcggatcgaggtccgcgccgccgggctcaacttccgggatgtcctggtggctctcggcatgtatccgggccggtcggtgatcggcacggagggctccggtgtggtgaccgaggtcggtccgggcgtcgcggagctggccgtgggcgaccgggtgatgggcctgttctccggctcgttcgggccgctggccaccgccgacgcgcatacggtgatccggatgccggatggctggtcgttcggcacggcggccggggtgccggtggcctatctgacggcgctgtacgcgttgcaggacctcgggagcgttcagccgggcgagacggtcctggtgcacgccgccgcgggcggtgtgggcatggccgccgtccagctcgcacagcacttcggcgccaccgtcctgggcaccgcccacccctccaagcaccacgcactccaccggcttggcgtgcccgccgaacggctcgcctccagccgcgacctcggctacgccgccgccttccccaccgccgacgtcgtgctcaactccctcaccggcgagcacatcgacgcctctctcggacttctcaatcccggcggccggttcctggagatgggcaagaccgacctgcgggagcccggcgaggtcggggcacggcatccggaggtcacctaccgggcgttcgacctcggcggggaggcccccgcggagcgggtgcgggagttgctgcaccagttggtggagctgttcgaggcgggccggatagagccgcttccggtgcggcagtgggacatcacccgcgcccccgaggcgttccgctggatgagccaggggcggcacaccggcaagatcgtgctcaccctcccccgcgccctggacccggacggcaccgtcctggtcaccggcggcaccggaaccctcggcgccaccgtcgcccgccacctcgtcacccagcacggcgcacgccgactactgctggtcagccgccggggaccggacgcacccggcgccaccgacctcaccaccgaactcaccgaactcggcgccaccgtccacatcaccgcatgcgacaccgccgaccgcgaccaactcgccaccaccctcgccgacatcccggccgaccaccccctcaccgccgtggtccacacggccgggacgctcgacgacggcatcctcaccgcactcaccccggaccgcctcgacaccgtcttccgccccaaggtcgacgccatcacccacctccacgacctcacccgcgaccaggacctggccgcgttcgtggtgtactcgtccgccgccggagtcctcggcggacccggccagggcaactactccgccgccaacgcctatctggacggcctcgcacagtggcggcgtgcgcacgggctccccgccacctcgctggcgtggggcatgtgggcgcagaccagtggcatgacggccgggctcggctcaggggatctgcaccgggtgcggcgtggcggcatcgtcgggctgtccacggcggaggcgctggacctgttcgaccggtcggtggcgtccgggctgtccctgctggtgccgttgcggttcgacctcgccgccctcggtgcggaggccgcggaaccgccgccgctgctgcgggggctggtccggccggcccggcgtacggcccggccggtgccgaaggccggtgagggcggcctcgtcgagcggctggccggtctttcggcggccgaacaggagcgtctgctggtcgagttgatccgcgaacaggccgcttccgtgctcgggttcccgaccgtcgacccgatcgggccggagcaggcattccgcgatatggggttcgactcgctgaccgcggtggagctgcgcaaccgcctcaacacggccaccggactacggctcccggcgacgctggtcttcgaccacccgacccccttggccaccgccgagctcctacgggacgaactgggcgggcgcgcggtcgaggccacgccccgcccggcccggcgcgaccggtcggctccggacgcggccgaggatccggtcgtcgtggtcggcatgggctgccgcctgcccggcgacgtccgcacccccgaggacctgtggcggctggtcgccgccggaaccgacgcgatcgggccgttcccgcaggaccggggctgggacctggccgggctcttcgactccgacccggacgccctgggcaagtcctacgtccgcgagggcggctttctcaccgacgcgggcggcttcgacgccacgttcttcggcatctccccgcgcgaggccctgtcgatggacccgcagcagcgtgtcctgctggagaccgcgtgggagaccctggaacgctccgggatcgttcccacgtcactgcgcggacaggaggtcggggtcttcgtcggggccagcggccaggggtacggcaccggtcctggcgcggctccggaaggcttggagggctatctgggggtgggcggcgcgacgagtgtggcgtcgggccggttgtcgtacaccttcggcctgaccggtccggcggtcacggtggacacggcgtgctcctcctccctggtggccctccacctcgcggcacaagctctgcgctccggcgaatgcacgatggcactcgcgggcggtgtcgcggtgatgggccagcccggcgcattcgtcgagttctcccgccagcgcggtctcgcgtccgacggccgctgcaagtccttcggcgagggcgccgacggcaccaactggtcggagggcgcgggtctggtgctgctggaacgactgtccgacgcccgccgcaacggccatgaggtgctggccgtgatccgtggcaccgcggtgaaccaggacggggcgagcaacggcctcaccgctccgaacgggccctcccagcagcgagtgatccggcaggccctgtccaatgccgggctcacagtggccgacgtggacgcggtcgaggcacacggcaccggcaccgccctcggcgaccccatcgaggcacaggcactgctcgccacctacggccaggaccgcccgggggacgaacccgtgtggctcggctcgctgaagtccaacatcggccacacccaagcggccgcaggcatatccagcgtcatcaagatggtcctggcgatgcggcagggcacgcttccccggtccctgcacgccgacgaacccaccacccaggtggactggacgtcgggcgcggtgtccctgctgaccgaggcacggccctggccggagaccggacacctccgccgcgccgggatctcctccttcggcgtcagcgggacaaacgcacatgtggtcctggagcaggccccggaagcggccgcaccgcaggcggacgaggccgacgacatccctggtctggtcgccaccggcgggatcgcgccctgggtcctgtcggccaagacccccacggccctgcgggctcaggcccaacgcctcctggaccacctggaatccggggtggacggccgccccctcgacatcggctggtccctggccaccacccgcaccctccacgaccatcgcgccataatcctcaccgacaccgacaccgacacgcgcgccgagggcggtgaggccacggccgccctgaccgccctcgtgaccggacagccgcatccccgcctcacgacgggctacgccaccacccagggcaagaccgtgttcgttttcccggggcaggggtcgcagtgggtggggatgggggcacagctcctggacacttcgcccgtcttcgcggcccggttgcgcgagtgtgccgacgcgctggccccgtataccgactggtccctgatggacgtcatcaccggcgcacccgatgccccttcgctcgaccgtgtcgacgtcgtacagcccgccaccttcgccgtcgtcgtctccctcgccaccctctggcaatccatgggtatccaccccgacgccgtcaccggccactcccaaggcgaaatcgccgcagcctgcgtcgccggacacctcaccctcaccaacgccgccaaaatcgtcgccctgcgcagccagatcatcgccgaccacctcgccggacacggcggcatgatgtccctcgccacccccgccgacaccatcgacctcaccaactggcacggcaaactctggatcgccgcacacaacggccccaacgccaccgtcatcgcaggcgacgccgaagccctgcaccaactccacgcccactacaccgaccaaggcatccgagcccgcatcatccccgtcgactacgcctcccacaccggacacgtcgacaccatcaagaacgaactccaccaaaccctggccgacaccaccaccgagcccggcaccctcccctggctctccaccgtcgacggggagtggatcgaacccaacaccctcgacagcacctactggtaccgcaatctccgccagaccgtgcagttccacaccgccatcaccaccctcgccgaccagggctaccgcacctacatcgaaatcagcccccaccccgtcctcaccaccgccatccaagaaaccctcgaaacacacaacacccccaacgcgatcgtcaccggaaccctccgccgcgacgacgacacccccacccgcctcctcaccaacctcgcccacctcaccacccacggaacacccgtcaactggcccaccctcttcaccggcacacaccccacccgcatcaccctccccacctaccccttcgagcaggagacgttctggctggaccgcagcggcccgggtgatgtccgtgccgtcggcctggaggacaccggccatccgctggtcggggccgtggtgagtgtgcccgacaccgacggtgtgctgctcaccgggcggctctccctgaccacccacccctggctggccgaccatgccgtctccggcaccgtcttgcttcccggtacggcgatggtggagctggcggtgcgagccggagacgaggcggaggcccgcgtactggaggaattgatcatcagtcggccgatggcggtgccggacgagggaaccttgcacgtccaagtgctggtcggcggcgaggaaggcgacgaaggcggacgccgcaaggtgggggtctactcccgccccgagggcatacggcagtggaccgagcacgccaccggcacactgctgaccgggggaaccgccaccgcggcggccacgacagcgcatccgtggccgcccgagggggccgaacccgtcgccctcgaggggttctacgagcaactggccgaggcggggtacgagtacggcccggcgttccggggcctgagcgcggtgtggaagcgggacgacgaggtgttcgccgaggtggccgtgccggaggaccagaccgcggtcgccggacggttcggcatccatccggcgctgctggacgccactctgcatgccgggaacttctgcttcgagtccggcggcgaccggcccacgatgctgccgttcgcctggaccgacgtgcggctccatgccgtgggcgccaccgctgtacgggtgcgggcgacggcgtccggcacggacgggctgtgtgtgcagatcaccgatccgcacggactgccggtcgccaccattggctcgctccagctccgggagaccacacccgagcagttgcgggccctctccgccacctcaggtggcaatgccttgtgggcggtcgaatgggccgaatgcgggctcgacgacacgacggaagcacagtgggccacactcggagagagccaactcctggactccccacttcactatgccgatgtttcccaggtcgtggcggccggggaacagcccgcggcactcgtcgccgacgtgtccgcatgggctcccgagaacaccgggccgcccatcgaccgcgcccacgcgctctgtgcccgagtcctcgatctgctgcggcaatgggtggaccggcccgagccggcggacacccggctggtgatcctgacccgcggtgccatggcggtccacgacaccgccgaggtcacggatgcggccgccgccgcggtctggggcctggtccgctcggcccagtccgaacacccgggccggatccagctcatcgacatcgacgagcactcccaccgcaccctgccgacagcactcaccaccaccgaccaaccccaactcgccctccgcgacgccaccgcctacaccccccacctggcccccgcgcccaccccaacacccgggcccctcaccctcgcgcccgagggaaccgtcctcatcaccggcggcaccggcaccctcggcgccctcaccgcccgccacctcatcacccaccacaaggcacgcaacctccttctggtcagccgccagggtccggacgcccccggcgcggaccggctgagcgaggagctgacccagctcggtgcccgtatccgcatcgccgcctgcgatgtcgccgaccgcgaccagctcgccaccgtcctcgccaccatccccgcagaccagccgctgaccgccgtcatccacaccgccggcgccctcgacgacgccctgctcaccgacctcaccccggaacgcctgggcaccgtcttccgccccaaggtcgacgccctcacccatctccacgacctcacccgcgaccatgacctcgcggccttcgtcatctactcctccgccaccggtgcgctcggcacccccggtcaggccaactacgcggcggccaacacctacgccgacgcgctcgcccagcagcgccacgccgccgggctccccgccacctcactcgcctggggcctgtgggaaaccaccagcgccctcacggccgggatgtccaccacccatcagcagcgcacccgccacagcggtgtcattcccctgaccgacgccgacggcatgcgcctcctcgacaccgcgctcaccacccaccagccccacctgatccccctcaagctcgatcgcaccgccctccggaacagcgccgcctcccacaccctcccgcccctgctccgcaccctggcgcaaagccaccaccgccccaccgcccacaccaccccccggaccgccgccgccccgcccctccccgagcaactcgccgccctcgatccggcccagcggctccagcacctcaccgcattcgtccgcgccgaagccgcggccgtgctcggacacgccacttcggacgcggtgggaccggacgatccgctcttcgagatcgggttcgactccctgaccgcggtggaactgcgcaaccggctcaacgcggccacgggcctccagctcccggcggcgttgctgttcgaccaccccaccccggcgatggccgccgaacacctccaggaacagctcgcgctgaaagacgcctcctgaggacgcctcctgagacggacaacagcgtccccggccgccgtggcggccggggacgctgccgtagggcgctcccccgccctcctcaccaggccgccgccgtacgccgtgcaacatgactggtcccttcccccggtttctttggggaagggaccagtttcactgacgggttccacggcccggcggccgtcgctcgttaggtgtccgaggtgacgctctccccggcccgggccgcgcggcggcgctcgtcgcccgccttgatcagggcgtacctgatggccagcgccgccgcgttgaccgcgtgcagcgcctcctgggcggcggagtccggctgttgctgtccggtggcggcggccgaggtggactgtgccgcctccaggcaggcgacgcacgcctccacgagggcgtccggccgcccgccggcccggcccagctccgtcagcagccgggtgatctcccggtgcacttcgccgatcgggtccgccaccatcggatcagccaccctcgagtcagccatcctcgggtccgccgccatcgggtcaacgcccccgcgcaccgtcgtccgcgggcccgtggcccgtcgggaggtccccggccggggccagggtgaggaaccgctgctcccacagggcgaacacctcggtggccagtgcctccgagagtccgccgacggtcttggccagatccccgagggtggtggtgccgtccaccgcgccgagcagttcgtacagctcgggcgagaccttcgcggacgggccgccgtcgtagtcgaggtggatctcgtgggtcctggctcccgccgaggcgtccggaccggccgtcctgcgctcgaccagccgggtcaccgggcggaaccgcggcaccagaacgcccaggtcaggcgcgggtttgccgcgtaccaggcagtcctccaccaccaggacgtccaggtcggtggtcaggaagctggtgaccacgtcgtcgaggctctgcacgatgggttcggcgttgttgttgaaggaggtgttgaggagcacgggggtgccggtcagttcgccgaaccgccgcaccaggcggtggaaccgctcgcccgattcggcggagacgacctgcacccgggcggtgccgtccacgtgggtgaccgcgccgagttccgtacgccgctccggcagcaccggcaccacgaaggacatgaactcgtggttgccgtccgcgccggagaggtcgaagtagtcgcgggcggcttcggccgtgaccaccggggcgaacggccggaagccctcgcgcttcttcaccatcgcgttgatgcgggtccggttctcctcggggcgggcgtccgcgacgatgctgcggtggcccagggcgcgggggccgaactcggagcggccgtacgcccagccgagcacctgtccctcggcgaggagtccggccgccgtctccacggcgtcgtccgggaactccacatcgatcagcggcgcccagtcggccagccgggccctgatctgctcccggccgcccattgccgggccgagactcgcgctgagcagccgtttgctcggccgctccaacgtgccgaggctcgccgcggcggcgtaggcggcgccctcgcccgcgcccgcgtcgtgcgaggcggggtgcacgaacacctcgtcgaagagcccggacttgaggatcagcccgttgaggctggagttgtgggcgacgccgccgccgaagcacaggcgggactggccgctggtcttcgcccagtattcgaggatgtgcagcacgatcttctcgaccgtctcctggagcgcggcggcgaagtcgcggtgggcctgggtgaacggctcgcccttgcggcgcggccggaagccctcggcgtagaacagcgggctgaccaggttcggcaccatgatgttgccgtgcaactcgtactcgccgttgtcctggagggtgtagagcttggcgaaggtgtcgcggtaggtctcggggttgccccagggggccaggcccatcaccttgtactcgtcgccgaagccgtagccgagcagataggtggcgttcagatagagcccgccgagcgacttgggcaccgggtagtcggccagcttctccaggtgcgtgccctcggcgcggtagacggtgccggagtgcagttcgccgcggccgtccagcaccaggaccagtgcggagtccatgccggagtgcagatacgaggagtacgcgtgcgcctcgtggtgcggcacgtacaccagcttctcgtccggcaggtcccagcccaggccctccttcagccgctgccggatcagctcccgggagtagcgcaggggggcccgcggatattcggtgtagaggtggttgaggacggtgtcgatgtggttctcggggaagtagtagcccaccgcgtcgacgtcctcgggccgcgcaccggccagggccaggcactcacggaccgcgttgaggggaaatttggttgtcttcttgatccggttgagccgctcctcctccacggcggccacgagttcgccgtcgcggatcaaggaagccgccgagtcgtgaaagaacacctcgccgagttgcggcaccacatcggtgtccgcggcggagaagttgccgttgagcccgagcacaagcacagtgatcacccaaaccagtcggaggcgaacgcgaggatgcggggcggaagacgcccgccggtcaccgggagcgcggcagcgccgggtcggccagctcaggcgccgtcagccgcagcgtcgtcggggccggctggaacgcgggggtgaggtggaggcgctcgaccccctcctcgtcgggggccgcgagcgcggcggtgcacgcgcaggtggtgtcggcgaacccggcgaagcggtaggccacctccatcatccggttgcgatcggtgcgccggaagtcggcggccaggtgcaccccggcctgtgccgcctgatcggccagccagttcagcagggtggacccggcgccgaaggacaccacccggcaggaggtggcgagcagtttcagatgccacaccgcggggtgccgttccagcagcacgatgccgacggcgccgtgcgggccgaaccggtcggccatcgtgatgaccagcacctcgtgcgcggggtcggtgagcagtccgcgcagtacggagtcggggtagtggacgccggtggcgttcatctggctggtgcgcagggtcagttcctcgacccgggacagctcccgctccgtggcgcgggagatgcccatccgtatgtccagggtgcgcaggaagtcctcgtcggggccgctgaactcggcccgctcggcgtcacggcggaatccggactggtacatgttccggcgctgccgggagtccacggtgaccacggcggggctgaactcgggcagcccggtgagcccggccaggtcctcggccgggtagcagcgcacctcggggagccggtaggcgacctcggcccgttcggcgggctggtcgtcgacgaacgccatggcgcggtcggcgaagttcagccggtccgcgatggcgcgtaccgacgcggacttggggccccagccgatatgcggcagtacgaagtactcggcgaggccgagggcctccaggcgctcccaggcgtggtcgtggtcgttcttgctggcgatggactggagaatgccgcgttcgtcgagggtggtgatgacatcgcgcacccactcgaagggcagcacctcgccgtcctcgagcagggtgccgcgccacagtgtgttgtccaggtcccagacgagacatttgacggccgtcggcggctcgctcacgggcttcccctccgtcatgcttgcaccttcttccgcgtgtgctgggcgaggacgagctggcagatctcgctggtgccctcgatgacttccatcagcttcgcgtcgcggtacgcccgggccaccacatggccgtcggatgcggcggccgacgccaggagctgtacggcgcgtgccgcgccgtcggccgcctcgcgggacgcgacgtacttcgcgtgcaccgcgtcgaccgccatatcgggcgagccggtgtcccaggaggcgctggcgtgttcgcaggcccgggtggcgtgccgctccgcgacgtacagctcggccaggtgccgggccaccaactggtgctcggcgagtctgcggccggactgttcccgggtggcggtgtgcgtggcggcggcgtccaggcaggcgcgcaggatgccgacgcacccccacgccacggacatgcgcccgtaggtgagcgccgcggtggtcaccaggggcagtggcagtccggtgccgccgagtacctggccggtgggcacccggacggcgtccagggtgatgtccgcgtggccggcggcgcggcagcccagcgggtcgggcacccgcgtgatgctgactccgggggcccgggcgggcacgaccacggccgcggcgccgccacgatatttcccgaacaccaccagcagatcggcgtagtgggcggcggtgatccacaccttgcggccggtgacgaccacgtgtgtgccgtcatcggcgatctcggtctccatcgcggccaggtcgctgcccgcccccgggctgctgaatccgaccgccgccagatcaccggaggtcagccggggcagaaaggtggaccactgttccgcgccacccagccgccgtacggtccacgccgccatgccctgggacgtcatcacgctgcgcagcgagctgcaccgggcgccgaccgccgcggtgagctccccgttggcacggctgtccagtccggcgccgccgtgctcggcgccgacctgcgcgcacagcacaccggaggcgccgagtttgaccaggaggtcgcggggcagctccccggccaggtcccaggcgtccgcccggtccccgatcaacccgctgaccagctccgtatggctggtggcggcgtcggtcacggctgtaccccgcgcagccgcaggaccatcgcggtcatcgcgttgaccgtgcggaagttgtccagcgccaggtcggggccggtgatcaccacgtcgaaggtcgactccaggtgcacgaccagctccatggcgaacatcgaggacacggcaccggagctgaacagatcggtgtccgggtcccaggtctgcttggtgcgctgttcgaggaactgctgcacctcctgcgccaccgtctcggcggtgtggctgcccggctcggatgagatggtcacgccagttccttcccgtatgcgtagaacccgcggcccgacttgcggcccaggtggccgtcgcggaccttcttcagcagcagttcgctcggcgcgcaccgggagtcgccggtgcgctcgtgcagcacgcgcagcgagtcggccaggttgtccaggccgatcaggtccgcggtgcgcagcggcccggtgcggtggcccaggcagtcccgcatgagtacgtccacggcctccaccgtggccgtgccctcctgcaccacccggatcgcgtcgttgatcatcgggtgcagcacccggctggtgacgaaccccggcccgtcgccgacgacgaccggcttgcgctccagcgcacgcagcagatccgtcacggcggtcatcaccgcttccccggtccggggaccgcggatcacctccaccgtggggatcagatagggcgggttcatgaagtgggtgccgaccagccgtgccggatcggcgatatgaccggccagttcgtcgatcgggatggaggaggtgttcgagatcagcggcacccgcgctccggtgagcccggcgaccgcttcgagcaccttggccttggtgggggtgtcctcggtgacggcctccaccaccgcggtggcgttccggccgtcggccagggacgcggtgaccgtcagctcgccccgcgggcggccggccggcagggctcccatgagctgcgccatgcggagccgttcggtgaccgcggcccgtgttcggccggccttggcctcgtccacctcgacgaccgtcaccgggattccgtgcccgacggcgagagaggtgattcccagtcccatcgttcctgcgcccagcaccgtgagccgcggcgcttccgcatctccgctcatcaatcgcctccgcagcgcgttgtgaacaacgtgccgaccatgacacgcgcttccgcgttcacggtattgtccgggcggtcacccaaatcccctaaggatcccccctatacccccctcagccggaatatgagttccagcattctggaagacgccattgcgcggcgcgtcgacggattcttagcatgggccgcattgcctttccctggtccttcccttttcagctttgcggggtgcggaaatccgatggctcagcaagtcgatgtgaccgaaaaaattctcggatatgtccgggaactgtccctgcgcgatgacgagatcctggccgggctgcgggcggagaccgcgggtctgcccgccgcccaggccatgcaggtgatgcccgaggagggccagctcctcgggctgctggtacggctcgtcggcgcccgttcggtgttggagatcggcaccttcaccggttacagcacgctgtgcatggcgcgggccctgccgaccgacggcacgctggtgacctgcgacatcacggcgaagtggccggggctcggccgcccgttctgggagcgcgccgaggtggcggaccgcatcgacgtgcgcatcggtgacgccaaggagacgctcgccgggctgcggcgggagggccgggagttcgacctggtcttcatcgacgcggacaagaccggatacgcgcactattacgaggagtcgctggcgatgctccggcgcggcgggctcatcgtcctggacaacaccctcttcttcggccgggtgaccgaccccgccgcgcaggacgccgacaccgccgccctgcgcgaggtgaacaagctgctccgggaggacggacgcgtcgagatcagcatgctcaccgttggtgatggcatcacgctcgcggtcaaacgctgaccacgtggccggggtccgaacgtctgacggccatgttccgggatcctcccgggacatggccgtccgcgcggctccgcggtcaggcgcgcggcaccgcggtcacgccaactccatccggtcggcgtacagttcggtcggcagttgctcccggtgcttgatgtccagcttgcggaacacccgggtcagatgctgctccaccgtgctggccgtgacgtacagcttcccggcgatctcccggttggtatagcccatggcggccagcgacgcgacccgccgttcggagtgtgtcagccgctcgatcgcggtgtccgacttcggcgttggcccggtggcatggccctggtcgtcggccggcagccactcctcgtacagcgacgccgcgtcgcacatcttcgccacatgccaggcccggcgcatggtccggcgggcctgcttcttctcgccgagcgcgtggtacgcctggctgaggtcccacagggtgcgggccagctcgtacttgtcctcctgctcggtgaacaggcccaccgcctcgttgagcaactgcggccgccgcttggccgaactggtggccgccagaaggcgtaacgactgtccgcgggcccgggcgccgtccgtgtgcggacggctgagctgctggtacaccaggatccgggcctggtcgtggttgccctgcgccagccatgcctccgccgccccgatccgccacggcaccgggtcgcagccgctgctcagcccccagtcggtgagcagttcgccgcagagcaggaagtccgcgagcgcggcctggtggcggcccgccgccaggaagtagtggccgcgcgcgtacaggtagtgcagcccgtaggagcttttgaacatggcgttgggcacggtctgcgcgacatggaaccccgcctcctcgtgccgccccatccgcgtacacgccaggatgagggcgccgagcggcagtccgatggcgacgccccaggcgccgggggaggcgtgggtgagggcggcgcgggactgctccgcggcctcggctaggtcaccgcggcgcagtgcgatctccgacctggcggccgacagcaccgcctgccgcatcgggacgtgcggtccaccaccggtctcgccgagcgcaccctcgcaccaggcggacgccaggtcgttccggccgccgtagaccagggcgagcagggcgaacagccccgcctgctcatggcaggccgggtcgtgtccgagctgaagttcgcgcagcacctcctcggcccggcggacggtgtcatgggtctgcccgccggtgagcacgtcggccaggaccgtaccggcccggggccacgccgccgcccgtgtcgccgcggcgccaccgtggtgcggcggtgccgcccgccgctcggccagccagggataggtgcaggtgagtgccgcctcgatggcatggagctggtcggtggccgcggggtccgcgcgcagatgggcgagcagcccctccacctcgctcagtccccccttccacaggagctgcatgagcagggtgacgctgtcggggaggccgagccggccggcccggacggcgccgtacagcggtgcgtggtgccgcgtggcggtggacggattgatcttccactccgcctcggcgagcttcgcccgcagggcggcgcggcgctcttcgtgcgggcattgctcgaaggactgctccagtaagtcgacggcgatggacgcctcttcgcccaccgccacctgctcggccacttccagaagcacctcggccgaccacgagtcggggatctgcccggcccgcaccagatgacgggcgatcgtggcggcgggcctgccctggtcgtgcagcagccgcgcggcccgctggtgcagggtcctgcgggcctgcgcgggcatgtcgttgagcacgctcagccgggccgtctcctgccggaacgcgccctcgtccatcagcccggccccggtcagcgccgcgagcacctggctgatgggctcgggctcgtgtccggtcagccaggcgaggtcggcggcgggcagggcggagcccaccacggccagcgcgcgcaccacgtccaggaagatcggctcattgcggtgcagacagctcaggaaggactggccgtagccggtctggcgggcctcgccgtactcacggtagtcggagagcaaggtgtgcagcagcagccggttgccaccggtggcggcgaggatgtcgccgacgtggcggcgcgcggtctcccccagctccgccacgaccacttcggccacctgacccggggaaagggggcccaggccgatgcggcgcaggtgctgggcgcgcagcagttcgtagcggagcggcagggacgaggacaggctcaggtcgtcggtgaatacggccgcgatgcgcgccgagtccaggcgccgtaccagttgcaggaggaaggctgcggaggccgggtcgctgtgccggacatcgtccacggcgaggagcagtggtgtgtgttccgcgtggtcgatcagcgaggtgcacagccggtggcacagccgggcgatcccggcccggtccaccggatcgccggccccgcggaggatgtccggcagccccggtacctcgggcggcccacccggtgacttccaggcgccgcgggccaattgcgagacgacgccgaagggaaggtcccgctcgctgggggagcatgtcgcggtgatggtgagatagccggattccgaggctcgttcggcgaacgaccggagcagggtcgtcttcccgcatgccagcggtccgtccacgagaagagcctccccgggccgcaccaaagagtcaccgaatggatgtccgaggtgcaccgcggtattcaataccccgcccagcggacgggaattccgctcggtattcaccggcatggcatagctgtagggcatggtgatggtccccgatcgaggtcgacggaatgcggactcgcggcccttgagtcagaccaaattgttgatcgggacacgattccatcagcacgcccctgcctgcctcaacccctaccggaagctccgccccctaaccggccccaccacatctcgttctccgcatcgggctgttcagttatccgtggcgggcgccgcacggtcaaccccctatcgagtccgtgcgcccctaaaacgcatgcggagaaaggtctcggtggcccggacaccgtgaggcatcaccatgcgggcgcgcggggcatcgccgcgagggtggtgctgacggtgtcctcggggatcccgcgcaccagtccgggcccctcggggccgtccaggacgaacgtcagcccgtcggtggccttcttgtccaggcgcatcagctccaccagctcggacaccgagacatccggcggcagcccggtcggcaggccgtagcgggatacgacgtcatggtgctcggcgacccgttccgggccgatgcgccccagcgcgccggcgagccggccggcgaagaccgtgccgatggccacgccctcgccgtggcgcagtgcgaacccggtggcgcgttccagcgcatgccccaaggtgtgtccgtagttgaggaggtggcgcaggccggagtcgcgttcgtccgccgcgacgatgcccgccttgagcgtcacactggccgagatctggtcgagcagcggcagcccgtcgaggtcgggcgcgccgatgaagtggcagcgggcgatctcaccgaggccgttgcgccattcccggtcgggcagggttttcagatgctcgaggtcgcagagcacggccgcgggctgccagtaggcgccgaccaggttcttgccctcgggcagattcaccgcggtcttcccgccgacgctcgcgtccacctgggcgagcagcgaggtcggcacatgaacgaccggggtgccccggtggtagagggcggcggccaggcccaccgtgtcggtcgtggtgccgccgccacaggacaccaccacatccgagcgggtgagtccgaatccgacgaaccggcggcacaggtccgtcacggcggccaggtccttggcctcctccccgtcgcgggcgggcacgacgagcgagggcactcccgggtcgggggtctgcccggcgggccgcgcggtgaccaccaccgccctgcgcgcgcccagggcggccaccacctgtggcagcagccgctgcacaccgtggccgatgtgaacggtgtaggagcgttcggccagcccgacggtgacctgccgggcaggggacgcggagccggtggccgaagtggaagtcgacgtggtcaagactgccttcccatcgctgacgcggccccggcgagaagccgtctcgccggggccggaatcgggtgcggagccgttttcagtcctcgaccgcgatcgcggcggccgggcagaggaacgacgcctcggcgacgctgtcgcgcagctcgagcggcggccgcgcatccagcaggaccacggtcccgtcctcctcccgctggtcgaaaacctccggcgccgccagcgcgcaatgcccggccgcgcagcacttgtcctgatccaccgagaccttcaccatcgtgttcccctcatcatccttctgtcatccgttccgcggtcaccaggcgacgggcacacgggcgacgccgaagttcatcgactcgtacagaaacgccaggtcctcgagcgggacctccaggcgcagcgtgggcagccggcgcagcagggtctccagagcgatctggagctcgacccgggcgagggtctgccccaggcactggtgcacgccgaagccgaacgcgacatgctcgcgggcgttgggccggctcaggtccagctcgtgggcgtccgcgaagtgggggtcccggttggcgctgggcaggttgatgatcaccccttcaccggccgggatgagtacgccgcccacctcgacgtcctcgacggccacccgtccggtgccttcctggacgatcgtgatgtaccggagcagttcgtccaccgcgttgcccatcagcccggcatcggcccgcagccgggcgagctggtcggggtggttcagcagcaggacggtggacagggcgatcatgttggcggtggtctcgtgcccggccagcagcagcaccagggcggtggcgaccacctgctgctgggtgagcccgcccgtcggctcctggtcgacgatgagccggctgagcagatcgtcgcccgggtcggcgcgcttggccgcgcacatccgggtcacgtagtccaccatgacgccgagcgcggcgcccatctcctcggccgacgcggtgaagtccatgacgccctgcgacgcctgctggaactccgcgaagtcggcgtccgagacccccagcatcacgccgatcacctgggacggcagggggaaggcgaagtcggccaccaggtcggccggcgggccctgggcgatcagccggtccaggaggccgtcgacgatgccctggatcatcggccgcatcgcctcggtgcgccggatggtgaagttcgcggtgagcatgcggcggatccgggcgtgctccggatcgtccatcctcccgaggttgaacacctcggccggcacctcgaacttcacaaagcggggcatcgccttgtgcgtgccgtcggcgctgaacctgctgtcgccgagcgccgcccgcgcctcgtgatagccggtgacgagaaacggggtgctgccgtcccacatccgcacccgcgtgacggcggaccgctcgcgcagttcctcgtatcccggcgggggtgagaacgggcatgcagcagcccgcaattcggggtagtcgcgtatctcgtccatgcctgtccgtcccgtcagtcgcttcgtcgccaccactgcgccgccctacggatggacaagtctggtccgcgcaccggatccccactcccctaaccactcccctatgcccccttggcttgggagcgggtatccccccgtgccccggcggcaggacgctcagcaggaggacgatccggtggctccgatgagctgccacagccgacgcgacagctcctgccgatttccgaccgagagctttcggtagatgcgggtcagatgctgctccacggtgctgaccgtgatgtagaggctcttggcgatctgccggttggacatccccgacgcggccagggtcgccacgcgccactcggcctccgagagaacgggctgctccgcgccttcggccgaggcggcggggtccgactcctcgggctccccggtatccccggcgggttccggcagtcgcgcgtccgcggggctctcggcgccatccacgacgaggtccctgcggctctcgtgctgggcgctgatcccgcactcgtccatcagcttctgcgcctcatgccaggtgccgcgggcctgctgggtttccccggtgctgaggaagtcctggctgagctcggcgagcgtacgggcgagttcgaaacggtcgccgtgctcgcgcagacacttggcggactgatacaggagcagcctgcgcttgtccgggtcttcggccatggccagaacgcgcagcgcccggccgcgggtgctcaaggggcggtcgggcgacagcttgagttcctccagggcgagtcttttggcctccgccggctcctggacacgcagatacgcctcggcggcgtcgatacgccagggcgccaggtcgccgaagtccacgggccactggtccatcagcatcccgctcaccatgaagtcgttcagcgctgcgtaggggcggttggtggccaggcagtactgtccacgggcccggaggtactccaacccgacaacgctgtcgaacatttccttcggcacccagtaatgcagatatcgctgggcctcatcgagtctgccgatggcggtgtgggccgccaccagaacggagagcggcaatccgatggcgacgccccagccgcgcggggggatggacttcagcgcggtgccggcgagatcgatggccgaggtgaagtccccatggcggcatctgatgtaggcgcgcatggccagggcgacggcgccgggcgtcttcatgttcaagttgccggccgcggtgaaaagcgcgccgcacagccggtccgccgtttccgcttcgcctctcgcggccaatgcccagaccatccggcaggcgtatgcgtaggcgaaccagaagtggttggagggcgacaacagatgcatggtgtcgggagagaagtccgccacctgccggggatcctggaaatgcccgatctccatgcccagttcgtcgacggagagctgaagaccgtgctccaggttggccgcccacagtccgtcgacttccccggccgaggaagcctggtcggggaagtcatggatcagggccggtttgaggaaggtggcccactgccgggtcacccgcagagcggccatgctggaggcgttatcggtgtcaccaccgcccgaaagccacttgaaggcttcttccccatcgctgaaccggccgaaccagagcaccatgaagagcaggaagcacagatactgttccgggatgtccgcggggaattcctcccgtatcgcggccatcaggcggtccagttcgggttcggcggtcgccggattgctggaccataacgcgccgaccagcgccatgagaatgtccatgtgctcgcgccggccgaggtccgcgcgggcggcgagccgcaggcccgcgatcgcttcctccgtacggccgtggtcgagattcttctgggccgcgtgccagagcacggtgacgtctttttggtcgggcgttctgtcggcggtgaccaggagttccgccaccgcgatcggatcggccccgtcggcatacagaagttcggccgctttcgcgctgagccgggcccggtcctccgccgacagcgtctccagcgtgatgtatcgcgccgcggggtgccggaaccgtccgtcctccagcagtccggcggagttcatgacggtgatggcccgggtcgcgcgttcccggccgcaggcgagcagactggccacccgccccgggccgccgtaccggtccagcaccgcgagggcctgtgccacctggagcaacgccggatgggacaacaggcacccgcgataggtctcctggaactccgcgccgacggtgacatccgtctccgacccgcccggagcggcctggagatggtcccgcagcagggccttgaccagccgtgggttgccaccgctgacggcgtggcaggaggcgcggatccggtcggccaggtcggcgtcgccgtgccgctccagcaggtgtccgaccccggattccgggagtgtatcgatcttgatcttgtagagctcatggaagccgtgagtgccgacacacaactgatgactctgcccgcaggtcatcacgacgagcgtacgggtgccggaggcatgcctggcgatatgcagcaggcacatgagggaggggtagtcggcatgctcggcatcgtcaaccgcgatgatcagttgcttgccgcccgcgatgcggtgcagcacatcggatatctctcggaccaggcttctcagtatgccgggttcggcttccgaataccgctctccggcggtcctccagcgcgccacgacgtccaattcatccgtgaacgcggacgaccagatgagctgttccactatattgaacgggatcgcggtgtcgtccgcgaatccggacgccataagacagaccgcacccgattcggccgcctgctccttcagactgcccaataaggaggtctttccgacaccgggtcccccggtcactttgagaagcccgccgtttcctcgtgctgccatgtcgaggacgccgcgaagctctgattgataatctgtcagtcccatactcatcagtcctcgctgtgggggtgtgtgcgtctgagcgatgagttgatctccgcggtcatcccaccctgcggaggaagccttctctgacgagacagataaccgctgcgccgacggcggctgattccctgatctggatcacctccggtgggagcccatgtccttgacgttcatacaagcagagtcacaaccggagcgaaaccgtccaccgatcatgatcagccacggtttccaaaccccgtgcgaacgtgcccgactgagcgggcggccccgtcctcgcacccccgagaagggcgggacgccgccagtgccggcttgcaggataaacgcgatgtgcggcatgccgacgcgaatgcacctcagcctctgaaccggttatggacccggcagtattccttaccctgtgcaaagctggtggcttaccagcagccgccccggccggtcgccgctccatgcccgtcccagcgggctccggagtgacaagtgtccaacctgcggccatcccccggttgcctcaaagtcatgtcgcataccattcccggcaacctcctcgcccctcagcagataatgcctgcccccgactcgtcgcggagatacggggattgacccctacatgctcaccgcgccagcgcgaccataaacggccgccgccccatgattcccctaaactctgcgccgtgatttggccggggtttatctgcctgcaaaacggccgaaacgggtgcgccatggaccgaacccgggaccgtccccgcggcatacgatgccggaagtcctgactgctggccacatcagagacgagggagcgtgaactgtgaccgtcaagggcgcgttgttcgacttctccgggactctgttccgaatcgagtccaccgagtcctggctccgtaccgagctgtacgacgccctctatgaccgccacctggagcccgcggcccggcagccctacccggacgccgccgaggggccggccgagctgcaccggcgcggggtgcggatcgcggtggtcagcgacatcggctgatcccgaaagggatcccgtggggcgaacccaccggttcggggcgatccccccgtgtcgcccgaaccggcggagacatgcggcggccctggaaggatcggcggacaaccgaacgtcgcctgagtatattggctgacagccagccaacgcaggagttacagc

SEQ ID NO: 3 - DNA, 10801 bp, Streptomyces hygroscopicus
tcccgggccgtgtcgggtggcagggccccgccgtgctcggcgcactcggtgtggggcagatcgtcacgttgttcttcacccggccggtcagatccgtgcaggacgcgctggcggaggagaccatctaccggatgatcctggagagccgcagtctgaaggtggcgctggctcggttccacatcaccacggcgacctcgctccggcggcatgacgatgtcgacgggcaatcccaggcactggcacggcagttggagatcctggagaagatcgacacagccgacttcgaacggctcaaacagctgggggtgaccccgcgcgccgaaccaccggggcccggccggtcccgcagaaggaaccgcgcacaggctccctgaacacctcctactgccgagcgaggggggctcgccgtcccgctaaggcccggccgtcagacctcgaccaccggtgtctggagttccgtgacccactcctcgcggttctccggacactccaggttgacctcccgggggtagccggacgaccggtagccgttgccgtcgatccaatgggccagggcctgggccgtgggcaccacggcgtccatcgggccgcggtggacgatggtcgcggcccggtcgacgggcggcagatcgaggatccggaggtcctcaccgtcccggagcggggcggagacctggacggcggcgtggacggtgatggcgccgccgccttccggggcgtcctcgtagtacgcgacaccggggcccgtcggggtgatgcccgccgcatcgaggcgccggaacagctcgtcgtagaggggtgtgatgaccgggccgatgtcccgggggtcgaagccggtggcggtcgcggtgagctccgccacccgcactgcccggatctccttgatgacgacgtcgttcgtgggcatgtgtccttcgctttcgatcgaccggagcctcgcctcgacctgcaccagccgtgccgccacggcggccacggtggcttccagctcggcccgccgcaaccgcagcatgccgcgcagttcctcggtgccggccttctcgtccacgatgtcccgcacctgctggagggtgaagccgagctctttgagcgcgatgacccggttcaggcggctgagctgggcggccgcgtagtagcggtagccggtggcggggtcgacatgggccgggcgcagcagtccggtggcgtcgtagtggcgcagcatccggaccgatacgcggccgtgccgggcgaagtctccgatggtgaacatgatgtctccgagtccagcgcctcacacggtgtgagggtcaaccctcgattcaggcactacattcgacaatagagaattcccggtcatcgcccatggagggacggacagcgcatgacggcgtcggctcatccgcatacccgcgtcatggtggaactcggcgaccgttcctatcccgtcgacatcgggccgggtgtccggcatgcgctgtccggggtcgtcgcggggctcggcgctcagcgggtggcgatggtctccgcccggccggacggctggctgcccgacccgggcgtgccctcgatggtgctgcgggcccgtgacggggaggcggacaagtcgctggccacggtggaggagctgtgccgggagttcgtccgtttcgggctgacccggtcggatgcggttgtctcctgcggtggcgggaccaccaccgatgtcgtgggtctcgcggcggcgctgtaccaccggggtgtgcccgtggtgcatctgccgacctcgctgctggcccaggtggacgccagcgtgggcgggaagacggcggtgaatctccccgaggggaagaatctggtgggtgctttctggcagccgtccgccgtgttgtgcgacaccgactatctggagacgctgcccgcagcggaaatgctcaatggatatggggagatcgcccgctgccacttcatcggcgccggtgatctgcgcgggctggcgctggcggagcagatcgcggcgagcgtggccctgaaggcatcggtggtctccgcggatgagcgggactccgggctgcgtcatgtgctcaattacggccacaccttgggccatgcgctggaaatcgtgaccgatttccggctgcggcacggtgagggggtggcgatcggcacggttttcgccggccgtctggcgctggccctgggccggatcgacgaggcgcgggcggcggagcatctggaggtggtgcggggttacgggctgccgttcgcgctgcccgccgatgccgatccgggtcgcctgatcgaggtgatgcggctggacaagaaggcgacggatgggctcaccttcgtcctggacggtcccggcggtcccgagctggtctcgggcctcgcggaggagacggtcgccacgacgctggccgggatggaccgggccggctcggacaaccgccggtagaaccggacgcggctcagtccggcagccccctggccagcagaacggcgccgtgcagtgaggacagcccgcccagtcgcgcgggccggaccggtggcatcggatgccccgggcgccccagcgccgccgtccgctcggccaccatcgccacgagctccggcatcgccgcggcgaaccctccgccgatcaacacgagcgcgggatggaccagttcgcatacgccggtcacggcagcggccagggccctgccgctctcccgcagcgccgccatggcccatggcttcccgtcggcgacggcctggcgcagcgcggcgaaggtcacgtcctcgccccgccgccgcgccgcccggcgcagggtcgccgggcccgaggccgccgcctggacgcagccgcgccggccgcagtcgcacagcggtccgtcgcggtccacgaccaggtggccgacttcgcaggagccgcggcccaggccggggacgggttttccgttcagcacgatgccaccaccgatcccggtgccgacgccgaggtagagcagatcggggcagccggcctcgtgtgcttcggcgagggcggccagatcgccgtcgtcggcacagcgcacctcggcgtcgccgaaaagcacggacagcgcgccacccaggtccactccggcccagccggggcggccgggccaggcggtgaccgtgccggtggcatcgagggtggcgggcatcgcgaccccgacgccggtgagccgctcgggggcgccggtgcataactccgtgacgtgatgcgccagcaggtccaggtcgagggtggggtcgccggacgtcatggcgtccgtaccgtccagctcggcccagcggaaggaggattcactgatgctcaggtcgtcgtgttcgaggcgcagcgccactttggtgccgccgacgtcgattcccagatgactgatggtcgcctcccggctcgtcggctttggcggtgtggagtgacggcggagtggccgctcagtccggcaccttctcgagcagggcgcgtgcggcgagccggtatcccagggcgccgagcccgaagatgacgcccgcggccagcgggcccgtcaccgactcatggcggaactgctcgcgggcccagacattcgacagatgcacctctatccagggccgcggatagttggccagtgcgtcccgaaggccccagccggccatcatgagcgcggccggattgatgatggcgccgaccgtgtcgtagttcccctgaatggtgtggatgatctccgcttcgccgtcgaactggtaggaatccactttccagccgcgctccgcgacctcttctccgacccagcgctcgatgtcctgcagcgtatccgtgccgtagatctcgggctgtcgcttcccgagtattccgagattcggtccgttcaccaacaacagtctgctcaatgcacacctcgccatgtggggtcggctgaattacagcggctcatcacggaagtgtatttatagcacggccctcttggcctcggcccgagagcttggtcaactccgtttttaagggggctgtaggggggccctgagggggaatgacgtttgctccgtcggccggttagcgtgctaatgcgtccgccgcggacctgcctccataacgcattaagggagtagggaaatcatgagcaatgatgtgcgcctgggatccgagctgcccgcatggcctcagtatggcgacgaggagcgcgaggggctcattcgggccctggatcaggggcagtggtggcgcatcgggggcggtgaggtcgacgccttcgaggcggagttcgccgcggcccacggcagcgagcacgccctcgcggtcaccaacggaacgcacgcgctggaactcgccctcgaggtactcggcatcggagccggcaccgaggtgatcgttcccgcgttcaccttcatctcgtcctcgcaggccgcgcagcggctgggcgcggtggccgttcccgtggacgtggacccggacacctactgcatcgatccgtcggcggtcgaggcggccatcggcccgaggacccgcgcgatcatgccggtgcacatggcgggtcagatgtgcgacatggacgcgctgggcaagctgtccgccgactcgggggtgccgctgatccaggacgcggcccacgcccacggagcgcagtggcgcggcaagaaggtcggtgagctgggctcggtcgccgcgttcagttttcagaacgggaagcttatgaccgccggtgagggcggcgccgtgctgttccccgacgccgagatgtacgagcggggcttcgtccggcacagctgcggacgtccgccctccgaccgcggctacttccaccgcacctcgggctccaacttccggctgaacgagttctccgcctcggtgctgcgcgcccaactcggccgcctggaggaccagatcaccacgcgtgagcagcgctggccggtgctgagccgactgctcgccgagatccccggtgtcgtaccgcagtcgcgcgacgaccgcggtgaccgcaacccgcactacatggcgatgttccgggtgccgggtctcaccgaggagcgccgcgcgaagatcgtcgacctgctcatcgagcgcggggtgcccgcgttcgtcgccttccgcgcggtctaccgtacggacgcattctgggagatggcggcgccggacctgacggtggacgagctcgcccgccgctgcccgcactccgaggcgctcacccgcgactgcctatggctgcaccaccgggtgctgctgggcagcgaggagcagatgcacgaagtggccgccatcgtcgccgacgtgctcgcgagctcatgagcgccccgcccgccgacgggacgccgatccggaccgccgtggtggggctggggtgggcggcgcgctcgatctggctgccccggctccgccgcaaccccgccttcaccgtgatcgccgcggtggatcccgacgagcgcggccgcgcggccgccgccgagatggagggcgcggaccggctgccggtgctggcggcggtccacgacctcgaccccgcggaggtggacctggcggtggtcgcggtgcccaaccatctgcactgcgatgtcgccaccgagctgctggccaagggtattccggtgttcctggagaagccggtgtgcctgacctccgaggaggccgagcggctggccgccgcggagcgctccggtggcgcggtgctgctggccgggagcgcggcgcgctaccgcgccgatgtgcgcgggctgtaccggatcgccgcccggctgggccgtatccgccatgtcgaactcgcctgggtgcgggcgcgcggcgtacccgaccggggcggctggttcacccagcggtcgctcgcgggcggcggggcgctggtcgacctgggctggcatctgttcgacatcgcggttccgctgctgggcaccgccgcgttccggcatgccatcggcaccgtgtcgtccgacttcatcacccagcggtcctcgcgggccgcgtggcggggcgacgacgacggcccggtgctctcgggcggcaccgatgtggaggacaccgcgcgcggattcctcgtcaccgacgacggccgttcggtcgtgctgcacgcgagttgggcctcgcatgaggcgctggacaccacgcgggtcacgatcgacggcagcgcgggcagcgcgaccttgcactgcaccttcggattcagcccgaaccgcctcgagaagtccaccctgacccgcaccgtcgacggtacgacccgtccggtggcggtacccaccgaaccgatcggcaccgagtacgaccggcagctcgacatggttcccgcgcagctgcgcgacccggcggggcggggccgggtgatcgaggaggtccgacggaccatcggcgccatcgaacgggtctacacctcggcccggatcccccaggaggtccgggagtcggtgtcggcgccggtgtgaccgcaccgggcggctgtcgcctcacccgctcgccttcgtcatcccttgccgccccatcccgctcgtcgtcgtcatcccctgccgtctcaccctgctcgccgtcgtcaacccctgccgtctcaccctgctcggcgtcgtcaaccccttctccggaccgccctgagacccggaccggcccgagacccggaccggcggtccgccgaaccggcccgcaccacgggagtcttcaatgaccagccatccgatcagtcacggcgccccgctctccggcgcgagtaccgccccggtcacctcggtggtcttcgacctcgacggtgtcctcgtcaacagcttcgcggtgatgcgcgaggcgttcacgctcgcctacgccgaggtcgtcggcgagggtgagccacccttcgaggagtacaaccggcatctgggccgctacttccccgacatcatgcggatcatgggtcttccgctggagatggaggccccgttcgtccgcgagagctaccggctcgcccacctggtggagatgttcgacggtgtgcccgagctgctgtcggagttacgccaccgcgggctgcggctcgccgtggccaccgggaagagcggaccccgggcgcgttcgctgctcgacacgctgggcatccgtggccagttccacgtggtcctcggctccgacgaggtggcgcggcccaagcccgcgccggacatcgtgctgaaggcgatggacctgatggacgccgatcccgaccgaaccgtgatggtcggggacgcggtgaccgacctggccagcgcgcggggggccgggatcaccgccgtggcggcgatgtggggtgagaccgacgagaagacgctgctcgcggcggagcccgatgtgatcctgcacaaacccgccgaactgctggcgctctgccccgaggtgacggctccgtagctccgcgcgccacgtccgtgcaggtacctccaccggggctttcgccgccgtgtcacacgccgtggtggctcacccggcccgcgcctgccgccggtgcgcccggccggcgttcgcctccccgccgtctcccggcggtgtggccggtcactgatcaagacgcgcacccccgtacgtcaccggccgggcggggggtgacggtggtgacgtacgggacacgacgggcggtcgctgattggcccgccacccgccgtgtcccgcatcatcgttgggctcagcccgccagccgcacgggttctgcggccttctcggccgcggccagcagtgcggtgatctcctcacgggcgcgggccacacgggagcgcacggtgccgatggggcagccggtcgcggtggcggcgtccgcgtacggcaggccgagtaccgtggtgaggaggaacatctcgcggcgcgccggggcgagcccagccagcaggtccatcagcgccaccccctcgtcgaacccggggagcccgacgggctgcgcccgttcggccacctcctgccagtcgtccgactccagggtgcgggggcgggcggcggtcatgcggtagcggtcgacgaccacccggcgggcgatcgacagcagccaggtgcgggccgatgagcggccggcgaagcgcgagagtccggtcagcgcccgcagatacgtctcctgggcgaggtcctcacagccgtgggggtcggcgctgagatggagtacgaagcggcgcacatcgcggtaggtggcgcggatgaagtggtcgaccgcgtcgcggtcgccgtcacgggcggccagcgcccatgcggtgacctggcggtcgttcgccgcggtggtgaagccgtgcatggctctcatcggtgcggcgggcagcgtggcggaaggcatcgtcacacgtccttcgggtggcggtgaacggcacaccggcatgcgccaccggccgcgcgcgggcgcggcggggcggcgaggagccggcggtgccgacggatggggccgacgccgggcaggcgccggtactccgcccgtcaaccggcactcaccccaggtcggggcgggggaaggacgggcggttcagcggacggcgaaccgcctcggtggccctctgcggagaatggcgtgccgtagcagaactccgcgcggccggcgggcgaaggccggtgcggacggccatgcgggcagcggagtggcgcccgcgccgaggatgcgcagggcgaggacgagcgggacgaacagcagggccgcgagcgcgcggccgaggcggaaggccgcgcgttcgccgcgccacagccacagtccgcagaccagcgcggcgagcaggtgggccgcggccatgcccgccccgccggggcccgcccagggccacggcagatggcccatcgacggcgcggcggaggacatcgcgtccgcgccatggtgcatgtggcccatggcgccgccgctcatcggggcggtgcccatgtcccgcataccgggcatccggtggcccatggcgcttcccgcggcgggagcgacggtcatctccgcgaatcggaacgccatgtgcaggccgagttgcgcgaccaccgtcgcaccggtcacgaccagcgctccgcgctcgcgcccggcgacccaccacgcggcggccgtcgtcgcggcgaacgcggcggccacggcccacaccggcagggcgtcgctggacatcagcgtgtgcccgagcgcggtcaccacgacgcacaccgccgcgaacacggcggctcgtgcgagacggaagggtggcccggcggacatggcagccatggtgccagccgtcgccggtgcgcgtgacgacggctcaatcttcatcacgccggtgacaagcgtggcgtgtgggccgcccccgaatgtgctcatgtgagccagttcacagatgatgcccggaactcagccgtgtgtgcggccgacaactcaaccggcggcccgatatgcgtccgcctcccgccgttgccccgagccaggagtcgtccatgtccgctgaaccgctcgccccggccacgggcgattccccggatgatgtcgccgacagggagccacgctccctcgccgaggccgagtccggcgggtccgggtccggcgggtccgtatgggcgggcctgcggccgctggtgctgcggctgcacttctacgcgggggtgctggtcgcgccgttcctgctggtcgcggcggtgaccggactgctgtacgccggatcgttccaggccgagaagctggtctacgcccacgagttgcgcgtccccgtcggcgaccgtgaactgccgatctccgcacaggtggcagccgcgcgcaagggccatcccgagggtgagatcagcgccgtacggccctcccccgaggacggcgccaccacccgggtgctgctctccggcgtcaagggcgtcgatcccgaccacacattggccgtgttcgtcgacccgtacaccgggaaggtgcgcggggcgctggagcagtacggctccaccggcgccctcccgctgcgcacctggatcgatgagttccaccgcgatctgcacctcgggcagaccggccgcctctacagcgaactcgccgccagctggctgtgggtcatcgccctcggcggtgtggtgctctggctcagccgtcgccgtaagaagcgcacgctgcgggcggtcgcgctgcccgaccgcgccgccaccggccgcaagcgcaccatgtccttccatggcgcggtggggctgtgggtggcgctcgggctgctgttcctgtccgccaccggcctgacctggtccacctacgcgggggccaacgtggaggacctgcgcaccgccctcggccagaccaccccgaccgtgtcggccacggtcggcggcggtgaacacgccggacaccacatgggttccggttccatgccgggcatggacatgggcggtacgggcgaggcggccgggcacaccgccgatgcgggcctggacaccgtgctggcggccgcccgcgccaaggacctggacaaccccgtcgagatcgtcccgcccgccgagccgggcagtgcgtatgtcgtcagccagatccagcggagctggcccgagaagcaggactcggtggccgtcgacccggccacgggcgaggtgaccgacgtccagcggttcgccgactacccggtgctcgccaagctcacccgctggggcatcgacctccacaccggaaacctcttcggcctcgtcaatcagatcgccctggccgctctcgcgctcgcgctgatccttctgatcgtctggggctatcgcatgtggtggcagcgcggtcgcgcctccgccttcggccgcccgatcccccgcggcgcgtggcggcgggtaccgctgtacgtcctcgtccccctggccgcggccaccgccgtgatcggctactacctgcccctcctcggtatcccgctcgcgaccttcctggccgtcgacatcgtcgcgggcgagatcgcccgccggcgccgcgccgcccccgccgcctgaccatcgctttgccatctcggcaacaagctttgcgctcac

SEQ ID NO: 4 - DNA, 529 bp, Streptomyces hygroscopicus
  misc_feature 405: n = A,T,C or G
gcccttttcgacgcggggttcttcgggatctccccgcgtgaggccgtggcgatggacccgcagcaacggctgttgctggagaccgcgtgggagaccttcgagcaggccggtatcgccccgcggtcggtgcagggcaccgacaccggcgtgttcgccggggtcatctaccacgactacgggacgaacgccggtgagctgcccgagggctcggagacctatctgagcacgggcaaatcggggagcgtggtgtccgggcgggtcgcctacgcactgggcctgaccggtcccgcggtgacggtcgacacggcgtgctcctcctcgctggtggccatccactgggcggccaaggcggtgcgggagggcgagtgctcgatggccctggccgggggcgtgacggtgatgtcnaccccggaggggttcgtgagcttctcccaccagcgtgggctcgcccccgatggccgcaacaagtccttcggcaagggcgccacgcacccacctccagcagaggggtgtccggccccttgcctgc

SEQ ID NO: 5 - DNA, 729 bp, Streptomyces hygroscopicus
gcccttttcgacgccgcgttcttcgggatctccccgcgtgaggcgctggccaccgatccgcagcagcggctgctgctggagaccgcgtgggagaccctcgagcacgcgggaatcgacccgagttcgctggaggacagcgacgtcggcgtgttcaccggcctggccaacggcgactacgcgctgaccgtggaccaggtgccggaaggcttcgaggggtatctgggccttggtggcgcgggcagcatcgcgtccggccgtatctcgtactcgctcggtctgctcggcccggcggtcactctggacaccgggtgctcctcgtccctcgtggcgatgcacttggccagttatgcgctcccggtccggggagtgctccatggcgctcgccggtggggtgatggtgatggcgacccctggcggcttcgtcggattctcccggcagcgggggctggcgcgcgacgggcgctgcaagtccttcggtgagggcgccgacggcaccaactggtccgagggcgtcggtcttgtgctgctggagcggctgtccgaagcccaccgcaacggccacccggtactcgcggtcatccgtggcacggccgtcaaccaggacggcgcctccaacggcatcaccgcgcccaacgggccgtcccaggaacgggtgatccggcaggcgctggcgaacgccggactgtcgctggccgatgtggacgcggtcgaagcccatggcaccggcac

SEQ ID NO: 6 - DNA, 723 bp, Streptomyces hygroscopicus
ttcgacgcggcgttcttcgggatctccccacgcgaggccctgtcgatggacccgctaacagcgcgccctgctggagaccgcgtgggagaccctggaacgctccgggatcgttcccacgtcactgcgcggacaggaggtcggggtcttcgtcggggccagtggccaggggtacggcaccggcccgggcgcggcgccggaaggcttggagggctatctcggggtcggcggtgcgacgagcgtggcatcgggccgggtgtcgtacaccttcggcctgaccggtccggcggtcacggtggacacgacgtgctcctcctcgctggtggccctccacctcgccgcgcaagccctgcgctccggcgaatgcacgatggcactcgccggcggcgtcgccgtcatgggccagcccggcgccttcgtcgagttctcgcgccagcgcggtctcgcgtccgacggccgctgcaagtccttcggcgagggcgccgacggcaccaactggtccgagggtgttggtctggtgctgctggaacggctctccgacgcccgccgcaacggccacgaggtgctggccgtgatccgtggcacggcggtgaaccaggacggcgcgagcaacggcctcaccgcgcccaacggaccctcccagcagcgagtgatacggcaggcgctggcgaacgccgggctgacggtggccgacgtggacgcggtcaaagcgcatggcaccgggac

SEQ ID NO: 7 - DNA, 722 bp, Streptomyces hygroscopicus
ttcgacgcggggttcttcggcatctcgccgcgcgaggccctgtcgctggacccgcagcagcggctgctgctggagaccgcgtgggagaccttcgagcgggcggggatggatccgcggtcggtggagggccgggacatcgcggtgttcgccgggggcagcggccaggggtacggcggcggtccgggtgaggcgcccaagggcctggagggctatctgggggtcggcgcttccggcagtgtcatctccgggcgcgtgtcgtacacgctcgggctgaccggtcccgccgtgaccgtggacaccgcctgctcgtcctcgctggtggccgcccatctcgccgtgcaggcgctgcggtccggcgaatgttccatggcgctggccggtggtgtcgccgtgatgggccagcccaccgccttcgtcgagttctcccggcagcgtggcctggcgcccgacgggcgctgcaagtccttcggcgcgggcgccgacggcaccacctggtccgaaggtgtcgggctcgttctgctggagcggctgtcggacgcccgccgcaacggccacgaagtgctggccgtgatccggggcaccgcggtcaaccaggacggcgcctccaacggactcaccgcgcccaacggcccctcccaggagcgggtgatccgccaggccctgtccaacgccgggctgacggtggccgacgtggacgccgtcgaagcccacgggaccggcac

SEQ ID NO: 8 - DNA, 721 bp, Streptomyces hygroscopicus
ttcgacgcggggttcttcgggatctcgccccgtgaggcgctggcgatggacccgcagcagcggttgctgctggagaccgcgtgggagaccttcgagaatgccggaatcgacccgggttcgctgcacggcaccgacgtcggtgtgttcagcggagtgatgtaccacgattacggggccgacgccgggacggcggcggagggcctggaggggcatctcggcgtgggcagcgcggggagcgtcgtctccgggcgggtggcctacgcgctgggcctgaccgggcccgcggtgaccgtggacaccgcctgctcgtcctccctggtagcgctgcacctggcggttcaggcggtgcgcacgggcgaatgctcgctggcgctcgccgggggtgtcgcggtgatgagcaggccgacgtcgttcatcgagttctcccgccagcgtggcctcgccccgacggccgctgcaagtccttcgcggagggcgccgacggcaccaactggtccgagggtgtcgggttggtgttgctggagcggctgtccgatgcccgccgcaatgggcatgaggtgctcgccgtcgtccgtggcaccgccgtgaaccaggacggcgccagcaacggcctgaccgcgcccaacggcccgtcccaggaacgggtgatccggcaggcgctggcgaacgccgggctgacggtggccgatgtggacgcggtcgaggcgcacggcacgggcac

SEQ ID NO: 9 - DNA, 739 bp, Streptomyces hygroscopicus
gtccccgtgccgtgcgcttcgacgccgagttcttcggcatctcgccgcgtgaggcgctggcgatggatccgcagcagcgactgctcgccgagacctcatgggagctgttcgagcgggcgggcatcgacccggtgtccgtgcgcggacaggccatcggggtgttcgccggggtcatcgaccagggatacatcgcccactccgaggcccctccgccggagttggagggctacctgatgacgggcagcaccacgagtgtggcctccggccgagtggcctacctgctgggcctcgaaggccccgcggtgacggtggacacggcgtgctcgtcgtcgctggtggcgctgcatctggccgtgcaggcgctgcgggcgggcgagtgctcgatggccatcaccggtggcgtgacggtgatcgccaagcccggcggtttcatcagcttctcccgccagcgcgggctcgcgccggatggccgcagcaagtccttcagcgagggcgccgacggcaccagcttcagcgagggcatcggtctggtgttgctggaacggctctccgacgcccgccgcaacggccacgaggtcctggccgtgatccgtggcacggcggtgaaccaggacggcgcgagcaacggcctcaccgcgcccaacggaccctcccagcagcgagtgatacggcaggcgctggcgaacgccgggctgacggtggccgacgtggacgcggtggaggcccacggcaccggcac

SEQ ID NO: 10 - DNA, 722 bp, Streptomyces hygroscopicus
ttcgacgcgggcttcttcggcatctcgccacgtgaggcgctggcgatggacccgcagcaacggctgttcctggaagcctgctgggaggtgttcgagcgggcgggcatggacccgacgacggtgggtggcggcgacatcggcgtgttcgccggcgtcatcaaccaggactacggcgtgcggagcgggcccgcccccgaggaccttgagggctatatgctcaccggctcggcgacgagtgtcgcctccggccgggtggcctatgtgctgggcctggagggcccggcggtgacggtggacacggcgtgctcctcctcactggtggccatgcactgggccgtacaggcgctgcgccagggcgagtgctcgatggcactggccgggggtgccacggtgatggggcggccgtcggcgttcgtggagttctcgcgccagcgtggcctggcgccggacggcctgcgcaaggcgttcggcgcgggtgccgacggcaccaccttcagcgagggtgtcggggtactgctgctggaacggctctccgacgcccgccgcaacggccacgaggtgctggccgtgatccgcggtacggcggtcaaccaggacggcgccagcagcggcctcaccgcccccaacggcccctcccaacagcgggtgatccggcaagcactcgcgaacgccgggctgtcggccaccgacatcgacgccgtcgaagcccacggcaccgggac

SEQ ID NO: 11 - DNA, 692 bp, Streptomyces hygroscopicus
gatgacccggcgtggatgctctacacctcgggcaccacgggcctgccgaaaggcgtgctgtccacacagcggaactgcctgtggtccctggccgcctgctacgtgccggtgacggggctgaccgccgaggaccgcgtgctgtggccgctgccgctgttccacagcctttcgcacatcgtgtgtctgctggcggccaccgccgtcggggccagcacccggatcgtggacggggtgtcgacggccgatgtgctggacgcactgcgcgaggagcggtcgaccttcatcgccggagtgccgacgctctaccaccacctgatcgaggcggcccgcgagcgcgacttcgccacgcccgagctgcggatcgcgctcgtgggcggggcggtggccacggcggacctggtcaggtcgttcgagtccgccttcggagtgccactcgtcgacgcctacggctccaccgagacctgtggcgcgatcgcggtgaactggccaaccggcccgcgggtcgaggggtcgtgcgggctgccggtgccggggctgacggtgcggctggtggacccggacaccggtgtcgacgttccggccgggcgggaaggcgagttctgggtgtccgggccgaacatcatggccgggtaccacaaccagccggaggcgacggcctcggcgctgcgcgacggctggtaccgcaccgatgg

SEQ ID NO: 12 - protein, 230 aa, Streptomyces hygroscopicus
DDPAWMLYTSGTTGLPKGVLSTQRNCLWSLAACYVPVTGLTAEDRVLWPLPLFHSLSHIVCLLAATAVGASTRIVDGVSTADVLDALREERSTFIAGVPTLYHHLIEAARERDFATPELRIALVGGAVATADLVRSFESAFGVPLVDAYGSTETCGAIAVNWPTGPRVEGSCGLPVPGLTVRLVDPDTGVDVPAGREGEFWVSGPNIMAGYHNQPEATASALRDGWYRTD

SEQ ID NO: 13 - DNA, 887 bp, Streptomyces hygroscopicus
aaggtgatggggttggcgccgtagggcaacccggagacctaccgcgacaccttcgccaagctctacaccctccaggacaacggcgagtacgagctgcacggcaacatcatggtgccgaacctggtcagcccgctgttctacgccgagggcttccggccgcgctgcaagggcgagccgttcacccaagcgcaccgcgacttcgccgccgcgctccaggagacggtcgagaagatcgtgctgcacatcctcgaatactgggcgaagaccagcggccactcccgcctgtgcttcggcggtggcgtcgcccacaactccagcctcaacgggctgatcctcaagtccggactcttcgacgaggtgttcgtgcaccccgcctcgcacgacgcaggcgcgggcgagggcgccgcctacgccgcggcggcgagccttggcacgctggagcgcccggggaagcggctgctcagcgcgagcctcggcccggcactgggcggccgggagcagatcagggcacggttggccgactgggcgccgctgatcgatgtggagttcccggacgacgccgtggagaccgcggccggactcctcgccgagggacaggtgctcggctgggcgtacggccgctccgagttcggcccccgcgccctgggccaccgcagcatcgtcgcggacgcacgccccgaggagaaccggacccgcatcaacgcgatggtgaagaagcgcgagggcttccggccgttcgccccggtggtcaccgccgaagccgcccgcgactactttgacctctccggcgcggatggcaaccacgagttcatgtccttcgtggtgccggtgctgccggagcggcgtacggaactcggcgcggtcacccacgtcgacgggaccgcgcg

SEQ ID NO: 14 - protein, 23 aa, Artificial Sequence
  Synthetic Construct
AARGTSATGGGSYTSGCSCCSTA

SEQ ID NO: 15 - protein, 23 aa, Artificial Sequence
  Synthetic Construct
CCSARSGCSCKSGGSCCRAAYTC

SEQ ID NO: 16 - protein, 23 aa, Artificial Sequence
  Synthetic Construct
CKSGCSSWSCCRTCSACRTGSCT

SEQ ID NO: 17 - DNA, 21 bp, Streptomyces hygroscopicus
cgagctgcacggcaacatcat

SEQ ID NO: 18 - DNA, 21 bp, Streptomyces hygroscopicus
gtccgggaactccacatcgat

SEQ ID NO: 19 - protein, 23 aa, Artificial Sequence
  Synthetic Construct
TTCGAYSCSGVSTTCTTCGGSAT

SEQ ID NO: 20 - protein, 23 aa, Artificial Sequence
  Synthetic Construct
GTSCCSGTSCCRTGSSCYTCSAC

SEQ ID NO: 21 - protein, 274 aa, Streptomyces hygroscopicus
MFTIGDFARHGRVSVRMLRHYDATGLLRPAHVDPATGYRYYAAAQLSRLNRVIALKELGFTLQQVRDIVDEKAGTEELRGMLRLRRAELEATVAAVAARLVQVEARLRSIESEGHMPTNDVVIKEIRAVRVAELTATATGFDPRDIGPVITPLYDELFRRLDAAGITPTGPGVAYYEDAPEGGGAITVHAAVQVSAPLRDGEDLRILDLPPVDRAATIVHRGPMDAVVPTAQALAHWIDGNGYRSSGYPREVNLECPENREEWVTELQTPVVEV

SEQ ID NO: 22 - DNA, 644 bp, Streptomyces hygroscopicus
cacctcgggcaccacgggcctaccgaaaggcgcgctgtccacccagcggaactgcctgtgtccctggccgcctgctacgtaccggtgacggggctgaccgccgaggaccgtgtgctgtggccgctgccgctgttccacagcctctcgcacatcgtgtgtctgctggcggccaccaccgtcggggccggcacccggatcgtggacggggtgtcgacccccgatgtgctggacgcgctgcgcgaggagcggtcgaccttcatcgccggagtgccgacgctctaccaccatctgatcgaggctgcccgcgagcgcgacttcgccacgcccgagctgcgcatcgcgctcgtgggcggggcggtggccacggccgacctggtcaggtcgttcgaggccaccttcggagtgccactcgtcgacgcctacggatccaccgagacctgtggcgcgatcgcggtgaactggcccaccggcccacgggtcgaggggtcgtgcgggctgccggtgccggggctgacggtgcggctggtggaccccgacgccggcgtcgtcgttccggccgggcgggaaggcgagttctgggtgtccgggccgaacatcatggccgggtaccaccaccagccggaggcgacggccgcggcgctgcg

SEQ ID NO: 23 - DNA, 644 bp, Streptomyces hygroscopicus
cgcctcgggcaccacgggcctgccgaaaggcgtgctgtccacccagcggaactgcctgtggtccctggccgcctgctacgtaccggtgacggggctgaccgccgaggaccgtgtgctgtggccgctgccgctgttccccagcctctcgcacatcgtgtgtctgctggcggccaccgccgtcggggccggcacccggatcgtgacggggtgtcgacctccgatgtgctggacgcgctgcgcgaggagcggtcgaccttcatcgccggagtgccgacgctctaccaccatctggtcgaggctgcctgcgagcgcgacttcgccacacccgagctgcggatcgcgctcgtgggcggggcggtggccacggccgacctggtcaggtcgttcgaggccaccttcggagtgccactcgtcgacgcctacggatccaccgagacctgtggcgcgatcgcggtggactggcccgccggcccacgggtcgaggggtcatgcggactgccgatgccggggctgacggtgcggctggtggaccccgacaccggtgtcgacgttccggccgggcgggaaggcgagttctgggtgtccgggccgaacatcatggccgggtaccacaaccagccggaggcgacggccgcggcgctgcg

SEQ ID NO: 24 - DNA, 599 bp, Streptomyces hygroscopicus
ggcaaccccgagacctaccgcgacaccttcgccaagctctacaccctccaggacaacggcgagtacgagttgcacggcagcatcatggtgccgaacctggtcagcccgctgttctacgccgagggcttccggccgcgccgcaagggcgagccgttcacccaggcccaccgcgacttcgccgccgcgctccaggagacggtcgagaagatcgtgctgcacatcctcgaatactgggcgaagaccagcggccagtcccgcctgtgcttcggcggcggcgtcgcccacaactccagcctcaacgggctgatcctcatgtccgggctcttcgacgaggtgttcgtgcaccccgccttgcacgacgcgggcgcgggcgagggcgccgcctacgccgccgcggcgagcctcggcacgttggagcggccgagtaaacggctgctcagcgcgagtctcggcccggcaatgggcggccgggagcagatcagggccggctggccgactgggcgccgctgattgatgtggagttcccggacgacgccgtgaagacggcggccggactcctcgccgagggacaggtgctcggctgggcgtacggccgctcc

SEQ ID NO: 25 - DNA, 598 bp, Streptomyces hygroscopicus
ggcaaccccgagacctaccgcgacaccttcgccaagctctacaccctccaggacaacggcgagtacgagttgcacggcaacatcatggtgccgaacctggtcagcccgctgttctacgccgagggcttccggccgcgccgcaagggcgagccgttcacccaggcccaccgcgacttcgccgccgcgctccaggagacggtcgagaagatcgtgctgcacatcctcgaatactgggcgaagaccagcggccagtcccgcctgtgcttcggcggcggcgtcgccacaactccagcctcaacgggctgatccccaagtccgggctcctcgacgaggtgttcgtgcaccccgcctcgcacgacgcgggcgcgggcgagggcgccgcctacgccgccgcggcgagcctcggcacgttggagcggccgagcaaacggctgctcagcgcgagtctcggcccggcaatgggcggccgggagcagatcagggcccggctggccgactgggcgccgctgatcgatgtggagttcccggacgacgccgtggagacggcggccggactcctcgccgagggacaggtgctcggctgggcgtacggccgctc

SEQ ID NO: 26 - DNA, 448 bp, Streptomyces hygroscopicus
ggatccggccgtaccggtagaggagtcgggacgaccggcagccgagttccggcgccgtgctgtgatgcgcgtcatgacaccgggctcgtccggcgagcgcgtgacctgctcagccctgttcatagtggctcggtctgccgtcacggtggacgagacggccgagccgctccgcgcgggcgcggggcatgagcgtccaggtgccgtcggtgcggtgcagggcggccgaatgccagggggtggtccagacatcggcggcgtccaggaggcggatgccgaatttggcggcgccgatgggctgggggtggatggacagccgtacggagccggggtggtgttcggcgatcaggtcgccccaggcccggctgcgctggatgacgccgtaggcacgggtgcggcatgcgcgttggagggcggagcgggtgccggtgaagtcggcggtgtcgtcgac

SEQ ID NO: 27 - DNA, 563 bp, Streptomyces hygroscopicus
ggatcccggccgtcctcggccgggggaccaaccacctgcccgtcggctacgaccgacgcgtctgacgcatgcccgcatgcccccatgcccgcgtcgcgcataccctcacggaggaacccacctcatgccgctgacgaccgcaccggacacccgctccacgagcggcatgagcgccgccatcctggacctgctgctgccgtaccaccgcacgaccgaccccacgcccacggcggcggagtcgttcgcgcaccagttgcgccagatcggcgggttcgtccgcgccggagaacccgtggtcctcaccctgcccggcttcccctgcaagtcgcccaaccccgccaaggttctcggccacctccccgaccagggcgaacgcctctccctcggctttctgaacaccctgtgcgaggagatcgagcgggtccacccgccgggcgcccgcgtgatcatctgctccgacggccatgtcttcggcgacctgatccgcgtcccggatgaccacatagacgcctacgcaaacgaactcagacgcctcatacgggagtggcactgcaccgcctctc

SEQ ID NO: 28 - DNA, 416 bp, Streptomyces hygroscopicus
ggatccaggagatcgtatgggactcggagagccgggcggtggggttgacggatgtgcgcccacgctgacgacgagggccgtcagagtggagcgaggcgggccttgagcaggcagaactcattgccttcgggatcggcgaggacgtgccactgctcctccccggtctggccgatgtcggcccgccgtgcaccgagcttcaggaggcgttcgagctcggcgtcctgatcgcggtcggtggcgttgacatcgatgtgcagccgggatttcccgggctccggctcgtccctgcggctgaggatgatcgtcggctgcggaccgccgaacccttcgcgcggcccgatctcgagggttccgtcgtcctcgcgatcgagcaccacgaagtccaggacctcgcaccagaatcgcgccagcacctc

SEQ ID NO: 29 - DNA, 411 bp, Streptomyces hygroscopicus
  misc_feature 187: n = A,T,C or G
ggatccggtcgctgaccgcccgctccccctcgcccggcgccaccagcccgcgcccctggatctccgcgaagagccgtacggccttcgcctgggcatccagcaaccgtgccgcgcgcgcgggttcgtcgtccgccatgggcccgacggtaggccgctagatcgtttcccggcaaccggatgaggcagncctcagtcggcgcggccggtcgccgccaccgtcacacccaggccgatcatcgcgaggccgcccgccccgccgaccatcgagaggcggcggtccgagcgggcgaaccaggagcgggccgccgaggcgcccaggccccacaaggtgtccgtgaccaggccgatggtgaccgggaccaggcccagcaccatcatctggacgggaacatgacccgccgagtggtcgac

SEQ ID NO: 30 - DNA, 485 bp, Streptomyces hygroscopicus
ggatccacacggcgccgccttcccccagccggtagttgtggaagtccgcttcatggctgccggttccggagccgaccagcgcgaacacatggaagtcggggcgctgcggctgggtacgacggcgctgggtgtccatcgaacgcagcgcggcgaaatccaggacctccaccccgtacgccgatcccacggcaggcagatagcgcagttgccgcaccgcactgtgtccgttttccacaatgaacgtgttcctttccgccaaggagtggacactccctcgcctacggtcgattccgcgcctgatcggcaggtcaggttactggttccgagctgcggcaggacgacggagtcgccttccgcggccgagagggaaggcgcgaagatgatggaaatgacaatgagagttcccgtggcgggcggatcgctcgatgtgcgagtcgggggcgataccggtccgacgctggtgttcgcccactactggggcggct

SEQ ID NO: 31 - DNA, 506 bp, Streptomyces hygroscopicus
ggatccctcagtgggagatcgaggaggtgctcgaagagcgggcgaccgccgccggcgcgcgggtactgcgcggcgccgccgtctcaggggtcgcgccggatgacgatggtgtggtcgtcacggcggacggtctgcgggcgcgggctcactacctggtggcgtgcgacggcggccacagtacggtgcggaaactgctcgggctgccgtttcccggccgggccggaacgcatcaggcggtgctggccgatatccggctgtccgccgtttcctcgctggtgccgcggcaggcggggcatatgagcaccctgacccgtcaggcgcggggctactggtccatgctggtccctgtcggcggcgaccggtaccggttcaccttcgggcatgcggaccaggcggacaccgcccgcgacaccgccgtcacccacgaggagatcgcggccgcgctggaggccgtgtacggccccgagaccaccctcggcggcgtggacaactcctcgcggttctcc

SEQ ID NO: 32 - DNA, 405 bp, Streptomyces hygroscopicus
ggatccgtaggcgtcgacgagtggcactccgaaggtggcctcgaacgacctgaccaggtcggccgtggccaccgccccgcccacgagcgcgatccgcagctcgggcgtggcgaagtcgcgctcgcgggcagcctcgatcagatggtggtagagcgtcggcactccggcgatgaaggtcgaccgctcctcgcgcagcgcgtccagcacatcggaggtcgacaccccgtccacgatccgggtgccggccccgacggcggtggccgccagcagacacacgatgtgcgagaggctgtggaacagcggcagcggccacagcacacggtcctcggcggtcagccccgtcaccggtacgtagcaggcggccagggaccacaggcagttccgctgggtggacagcacgccttt

SEQ ID NO: 33 - DNA, 439 bp, Streptomyces hygroscopicus
  misc_feature 360: n = A,T,C or G
ggatccggtcgtcgtggtcggcatgggctgccgcctgcccggcgacgtccgcacccccgaggacctgtggcggctggtcgccgccggaaccgacgcgatcgggccgttcccgcaggaccggggctgggacctggccgggctcttcgactccgacccggacgccctgggcaagtcctacgtccgcgagggcggctttctcaccgacgcgggcggcttcgacgccacgttcttcggcatctccccgcgcgaggccctgtcgatggacccgcagcagcgtgtcctgctggagaccgcgtgggagaccctggaacgctccgggatcgttcccacgtcactgcgcggacaggaggtcggggtctncgtcggggccagcggccaggggtacggcaccggtcctggcgcggctccggaaggctggagggctatctggggggtgggc

SEQ ID NO: 34 - DNA, 377 bp, Streptomyces hygroscopicus
ggatccggcccgggtgttcggactgggccgagcggaccaggccccagaccgcggcggcggccgcatccgtgacctcggcggtgtcgtggaccgccatggcaccgcgggtcaggatcaccagccgggtgtccgccggctcgggccggtccacccattgccgcagcagatcgaggactcgggcacagagcgcgtgggcgcggtcgatgggcggcccggtgttctcgggagcccatgcggacacgtcggcgacgagtgccgcgggctgttccccggccgccacgacctgggaaacatcggcatagtgaagtggggagtccaggagttggctctctccgagtgtggcccactgtgcttccgtcgtgtcgtcgagcccgcat

SEQ ID NO: 35 - DNA, 541 bp, Streptomyces hygroscopicus
ggatccggtcggccaggtcggcgtcgccgtgccgctccagcaggtgtccgaccccggattccgggagtgtatcgatcttgatcttgtagagctcatggaagccgtgagtgccgacacacaactgatgactctgcccgcaggtcatcacgacgagcgtacgggtgccggaggcatgcctggcgatatgcagcaggcacatgagggaggggtagtcggcatgctcggcatcgtcaaccgcgatgatcagttgcttgccgcccgcgatgcggtgcagcacatcggatatctctcggaccaggcttctcagtatgccgggttcggcttccgaataccgctctccggcggtcctccagcgcgccacgacgtccaattcatccgtgaacgcggacgaccagatgagctgttccactatattgaacgggatcgcggtgtcgtccgcgaatccggacgccataagacagaccgcacccgattcggccgcctgctccttcagactgcccaataaggaggtcttccgacaccgggtccccggtcacttgga

SEQ ID NO: 36 - DNA, 494 bp, Streptomyces hygroscopicus
ggatccctttcgggatcagccgatgtcgctgaccaccgcgatccgcaccccgcgccggtgcagctcggccggcccctcggcggcgtccgggtagggctgccgggccgcgggctccaggtggcggtcatagagggcgtcgtacagctcggtacggagccaggactcggtggactcgattcggaacagagtcccggagaagtcgaacaacgcgcccttgacggtcacagttcacgctccctcgtctctgatgtggccagcagtcaggacttccggcatcgtatgccgcggggacggtcccgggttcggtccatggcgcacccgtttcggccgttttgcaggcagataaaccccggccaaatcacggcgcagagtttaggggaatcatggggcggcggccgtttatggtcgcgctggcgcggtgagcatgtaggggtcaatccccgtatctccgcgacgagtcgggggcaggcatatctgctgaggggcgagagtgc

SEQ ID NO: 37 - DNA, 334 bp, Streptomyces hygroscopicus
  misc_feature 239, 279, 282, 309: n = A,T,C or G
ggatcccaagcgccccaggaggccacggtgttgaaccgccgtacgacgctccacaccgcatccctcgcggccgccgtggctgcggccctggcactcgccctgaccggctgtgacacggagagcggcggcaaggccgacgccggaaagggcaaggacgggaagcccgcggtgatcgcaccgggcaagcccggcgaggcggcgaagaagctgtcggccgaggaggcggcgaaggcgggggnttttattgactcccccaaccacggccgaccgctccctacngtnccggatgatgatcgagcaccatgcgcnaggccctggctgatgaccgacctcg

SEQ ID NO: 38 - DNA, 406 bp, Streptomyces hygroscopicus
  misc_feature 262, 352: n = A,T,C or G
ggatccgacgaccgcgacgcgaagcacgaaggagccccttccgcaggatgtctccagcatcccacccggcggggcgccgtgtccggtactacgcgccgggggaccggcccggatgacgcctcccggccaccggtccacgggcccgcgaccgcgccgcgagcccggctcgacgagaaccggcgcaacggcccgtacgcccccgtacgcctctctacgcccctctacgagatccgcctacgaatacctgcctacgacattttgncttttcatccgccggatctcgctgctctgctgcgcgatcacatcgcccgccatctcctccacctggacgttgttcccctgggccagcacnatccgtggccatggagaccgcgccccggtgatgggcgatcatcagcttgaggaa

SEQ ID NO: 39 - protein, 265 aa, Streptomyces hygroscopicus
MSTFGGGPHATLVTGVMKIEPSSRAPATAGTMAAMSAGPPFRLARAAVFAAVCVVVTALGHTLMSSDALPVWAVAAAFAATTAAAWWVAGRERGALVVTGATVVAQLGLHMAFRFAEMTVAPAAGSAMGHRMPGMRDMGTAPMSGGAMGHMHHGADAMSSAAPSMGHLPWPWAGPGGAGMAAAHLLAALVCGLWLWRGERAAFRLGRALAALLFVPLVLALRILGAGATPLPAWPSAPAFARRPRGVLLRHAILRRGPPRRFAVR

SEQ ID NO: 40 - protein, 497 aa, Streptomyces hygroscopicus
MSAEPLAPATGDSPDDVADREPRSLAEAESGGSGSGGSVWAGLRPLVLRLHFYAGVLVAPFLLVAAVTGLLYAGSFQAEKLVYAHELRVPVGDRELPISAQVAAARKGHPEGEISAVRPSPEDGATTRVLLSGVKGVDPDHTLAVFVDPYTGKVRGALEQYGSTGALPLRTWIDEFHRDLHLGQTGRLYSELAASWLWVIALGGVVLWLSRRRKKRTLRAVALPDRAATGRKRTMSFHGAVGLWVALGLLFLSATGLTWSTYAGANVEDLRTALGQTTPTVSATVGGGEHAGHHMGSGSMPGMDMGGTGEAAGHTADAGLDTVLAAARAKDLDNPVEIVPPAEPGSAYVVSQIQRSWPEKQDSVAVDPATGEVTDVQRFADYPVLAKLTRWGIDLHTGNLFGLVNQIALAALALALILLIVWGYRMWWQRGRASAFGRPIPRGAWRRVPLYVLVPLAAATAVIGYYLPLLGIPLATFLAVDIVAGEIARRRRAAPAA

SEQ ID NO: 41 - protein, 23 aa, Artificial Sequence
  Synthetic Construct
AARGTSATGGGSYTSGCSCCSTA

SEQ ID NO: 42 - protein, 23 aa, Artificial Sequence
  Synthetic Construct
CCSARSGCSCKSGGSCCRAAYTC

SEQ ID NO: 43 - protein, 23 aa, Artificial Sequence
  Synthetic Construct
GAYGASCCSGCSTGGATGYTSTA

SEQ ID NO: 44 - protein, 23 aa, Artificial Sequence
  Synthetic Construct
CCRTCSGTSCKGTACCASCCRTC

SEQ ID NO: 45 - DNA, 38 bp, Streptomyces hygroscopicus
ttgaattcagatctagttcgctggaggacagcgacgtc

SEQ ID NO: 46 - DNA, 39 bp, Streptomyces hygroscopicus
tttctagaggatccgccgtctgttccggtctgtccggtg

SEQ ID NO: 47 - DNA, 38 bp, Streptomyces hygroscopicus
tttctagactgcagcgcggcggtccgggcgacgtccgt

SEQ ID NO: 48 - DNA, 37 bp, Streptomyces hygroscopicus
ttaagcttatgcatcgggtcgtgacctcggcggtgtc

SEQ ID NO: 49 - protein, 24 aa, Artificial Sequence
  Synthetic Construct
GTSATCGTSCCSGCSTTCACSTTC

SEQ ID NO: 50 - protein, 23 aa, Artificial Sequence
  Synthetic Construct
ATCATGCCSGTSCAYATGGCSGG

SEQ ID NO: 51 - protein, 23 aa, Artificial Sequence
  Synthetic Construct
GGSTBSGKGAACATSGCCATGTA

SEQ ID NO: 52 - protein, 23 aa, Artificial Sequence
  Synthetic Construct
CKRTGRTGSARCCASTKRCARTC

SEQ ID NO: 53 - protein, 22 aa, Artificial Sequence
  Synthetic Construct
TTCGAYSCSGVSTTCTTCGSAT

SEQ ID NO: 54 - protein, 23 aa, Artificial Sequence
  Synthetic Construct
GCSATGGAYCCSCARCARCGSVT

SEQ ID NO: 55 - protein, 23 aa, Artificial Sequence
  Synthetic Construct
GTSCCSGTSCCRTGSSCYTCSAC

SEQ ID NO: 56 - protein, 22 aa, Artificial Sequence
  Synthetic Construct
ASRTGSGCRTTSGTSCCSSWSA

SEQ ID NO: 57 - protein, 23 aa, Artificial Sequence
  Synthetic Construct
TGSGYRTGSCCSAKGTTSSWCTT

SEQ ID NO: 58 - protein, 22 aa, Artificial Sequence
  Synthetic Construct
ASRTGSGCRTTSGTSCCSSWSA

SEQ ID NO: 59 - DNA, 21 bp, Streptomyces hygroscopicus
aggacagtggcgcggcaagaa

SEQ ID NO: 60 - DNA, 22 bp, Streptomyces hygroscopicus
ggtcgacgatcttcgcgcggcg

SEQ ID NO: 61 - DNA, 21 bp, Streptomyces hygroscopicus
tcgacgtggctgccgcggctt

SEQ ID NO: 62 - DNA, 21 bp, Streptomyces hygroscopicus
tgtcgacgagggcgttgcggg

SEQ ID NO: 63 - DNA, 38 bp, Streptomyces hygroscopicus
ttgaattcagatctacgtcactgcgcggacaggaggtc

SEQ ID NO: 64 - DNA, 39 bp, Streptomyces hygroscopicus
tttctagaggatccgccgtgggtggtggcgtggccggtg

SEQ ID NO: 65 - DNA, 38 bp, Streptomyces hygroscopicus; identical to SEQ ID NO: 47

SEQ ID NO: 66 - DNA, 38 bp, Streptomyces hygroscopicus
ttaagcttatgcatcgggtcggtgacctcggcggtgtc

SEQ ID NO: 67 - DNA, 38 bp, Streptomyces hygroscopicus
ttgaattcagatctgtgttcgccggggtcatctaccac

SEQ ID NO: 68 - DNA, 39 bp, Streptomyces hygroscopicus
tttctagaggatccgccgtcgctgcccgtctccccggtg

SEQ ID NO: 69 - DNA, 38 bp, Streptomyces hygroscopicus
tttctagactgcagcccgccaggacaccgacgcgggcc

SEQ ID NO: 70 - DNA, 38 bp, Streptomyces hygroscopicus
ttaagcttatgcatggcgttgcccgccgcgtacggggc

SEQ ID NO: 71 - DNA, 32 bp, Streptomyces hygroscopicus
cgggatccgagccccaactggcggtgcgcggt

SEQ ID NO: 72 - DNA, 55 bp, Streptomyces hygroscopicus
gcggagaagttgccctggccgggcccgcctaggactccggcggcggacgagtaca

SEQ ID NO: 73 - DNA, 58 bp, Streptomyces hygroscopicus
ccggagtcctaggcgggcccggccagggcaacttctccgccgccaacgcctatctgga

SEQ ID NO: 74 - DNA, 32 bp, Streptomyces hygroscopicus
gctctagagggtccgttgggcgcggtgaggcc

SEQ ID NO: 75 - DNA, 27 bp, Streptomyces hygroscopicus
tcctaggacatatggcgaatgacgagc

SEQ ID NO: 76 - DNA, 20 bp, Streptomyces hygroscopicus
gcgtcgaagaggttctccag

SEQ ID NO: 77 - DNA, 38 bp, Streptomyces hygroscopicus; identical to SEQ ID NO: 45

SEQ ID NO: 78 - DNA, 39 bp, Streptomyces hygroscopicus; identical to SEQ ID NO: 46

SEQ ID NO: 79 - DNA, 38 bp, Streptomyces hygroscopicus; identical to SEQ ID NO: 47

SEQ ID NO: 80 - DNA, 38 bp, Streptomyces hygroscopicus; identical to SEQ ID NO: 66

SEQ ID NO: 81 - protein, 4 aa, Artificial Sequence
  Synthetic Construct
YASH

SEQ ID NO: 82 - DNA, 12 bp, Streptomyces hygroscopicus
tacgcctcccac

SEQ ID NO: 83 - protein, 4 aa, Artificial Sequence
  Synthetic Construct
HAFH

SEQ ID NO: 84 - DNA, 12 bp, Streptomyces hygroscopicus
cacgccttccac

SEQ ID NO: 85 - protein, 762 aa, Streptomyces hygroscopicus
MADEPTALAAMTDLSIGGMTCAACVKRVEKKLARLDGVTATVNLATGRARVNHPPEVGPDQLIATVEQAGYTAALPEPPRKERSEDRDAAQDARRERDRLVVTALLAVPVLVVSMVPGLQFRNWQWLCFVLAAPVVVWGAWPFHLRAARGLRHSAATMDTLVSLGVVASFAWSSYALFFGGAGEPGMRMPFSLVPTASDGVAHVYLEAAVGVPLFVLAGRFLETRARLGTGAALRALARLAGKEVSVRDGDGERLVPIEELRVGQVFVARPGERLATDGTVVEGSSAVDLSLVTGESEPVEVGPGTPVTGGAVNAGGLLLVRATAVGADTQLSRITRLVTEAQAGKARAQRLADKAAGVFVPVVLTLAVTVLGFWLGAGAEPQAAITASVAVLVVACPCALGLATPTALMAATGRGAQLGVLVSGPQALEGLRHLDAVVLDKTGTLTSGQMSVARVTAVPGGLGEEELVRLAGAVEQGSEHPLGRAITAHARRTVPGKSLPAVADFVALPGKGVRGRVADRLVEVLAPDDALPPVLAQALSASETAARTPVVVRVDGETEALIEVGDVLRPGSYRAVERLRRLGVRPVLATGDREAPARAVATDLRIEEVHARCTPEDKAALVRELREQGYRVAVVGDGVNDAAALAGADLGIAMGTGTDVAIGAADVTLVRGDIETLADAVRLARSALATIRVNLLWAFGYNAVTVPLAMVGLLNPMLAAAAMSVSSLLVVGNSLRLRAWQPSPAGHRPSRPAAPAARKPL

SEQ ID NO: 86 - protein, 138 aa, Streptomyces hygroscopicus
MNRAEQVTRSPDEPGVMTRITARRRNSAAGRPDSSTGTAGSAEAVRSDWKFPHMAQPRPSARRTPGAFLSRALPPPALCGFLLLLVMVFAASYAVGAGAGPVAPGMHGSSTTDGGSGDGHGGGGMDMGGMDTDQGSGR

SEQ ID NO: 87 - protein, 327 aa, Streptomyces hygroscopicus
MPPCPRRAYPHGGTHLMPLTTAPDTRSTSGMSAAILDLLLPYHRTTDPTPTAAESFAHQLRQIGGFVRAGEPVVLTLPGFPCKSPNPAKVLGHLPDQGERLSLGFLNTLCEEIERVHPPGARVIICSDGHVFGDLIRVPDDHIDAYANELRRLIRELALHRLSVFDLRDILGDLPHHTKRAQVHERYAPTLEALRAEVRSEDHTLALYRGITRFLVDDTADFTGTRSALQRACRTRAYGVIQRSRAWGDLIAEHHPGSVRLSIHPQPIGAAKFGIRLLDAADVWTTPWHSAALHRTDGTWTLMPRARAERLGRLVHRDGRPSHYEQG

SEQ ID NO: 88 - protein, 418 aa, Streptomyces hygroscopicus
MTLQESGTAPEALPEPVPLMGCPYKSNPYPLYERMRETGPVHRVRFPSGVLAWLVTGYDAAHSALGDERLGKNHDRGNDRWRARASIMPEPQHSQLQVHLLHQDPPTHTRMRRFVTDAFTPRRIEQLRPRFQKLADTLVDALPETGPADLVTGFAARFPFQVLAEVIGLPDELAARFDRDWGKVVQPVGPADPGRPLYEARLHGLQSYIAEVVAHKREHWADDLLSRLVVAHDRRELSQEELDSMIFQLLVAGQEPVTNQITTALIALFRHPAELARLRDNPELMPRAVDELLRYDSAFELTTWRFFDQDSDLHGTEVPAGDSVIISLCAANRDPRRFPDPDTLDLDRSPNPHLAFGHGIHFCPGAALARAELQIALGTLLTRLLGAHLAIDDGDIEWIPAVLGRGTNHLPVGYDRRV

SEQ ID NO: 89 - protein, 608 aa, Streptomyces hygroscopicus
MCGITGWVSFHQDPRTQAPVIEAMTATLAPRGPDAAGVWLGPRAAIGHRRLAVIDLAGGVQPMTDRPDAPTTVLTYSGEIYNHHELRSQLSGLGHEFRTRSDTEVVLRGYAEWGEKVADHLDGMFAFAVWDERAQRLLLVRDRLGVKPLFWAEVDGGLAFASEPKALFAHPEIRPRVDADGLREAYSLLFNTGPTVWSGVREVEPGGLLLLDRDGIRERRYWQLEADAHPDDRDATIARVHDLVSTAARAQLEADVPLCSLLSGGIDSTVLTALLADELRLREGPGARIRSYAVDYSDQAESFTGDVLRTGHDTPYATEAGAFLGTDHSTVVLDPRALLDPEHRRAVVVARDSPIGVGDMDTSLHLLFGEIRKHSTVALSGEAADEVFGGYPWFHNPKALATATFPWLLVTGDEAAMPLNPELDLRIGEFRDDTYRTALAAVPHLDGETPTEHRQREMQHLSLTRWLRQLLHRKDRLSMAQGLEVRVPYCDHRLVEYAFTTPWALKNFDGREKSLLRAAGTGLAPDSVLHRPKNHYPATHHPDYNRGLQNMARDALADDTVRSLADETRLKPCLDTPPGQLEWGHRLRLERVVDLALWLDHYQPELAL

SEQ ID NO: 90 - protein, 476 aa, Streptomyces hygroscopicus
MTDDASGADQAGDVPERPADPPEVHDRWLLVAVAGALAFVAMLDMNIVNVALADISQGLRVPAATAQWAVLGYQLPVVALLLPVGRWLDDVGTRPALLVATGGFALCSALAAASPWAAWLIAARIGQGACGAVLFVLMPVLALRSVRPELRGRAMSVPATLGPLGAVAGPAVGGLLLDHLGWRWIFLVKIPFCLLALAVVWRAMPRDGRLRGADRRFLADTALIATGVTILLLSLTLASDTPAWLPLALVAAPPLWWWLRGPGGRPVAGVLRAAGLLRAHGAVLALAVGFAAMHYVVALHLQRDEDVSATTTGLTVLAFPLGMGLAGPLGGRLADRYGARPVAVTGAALTTVGLLLLVPLGDGWSPPDVAWRLALAGLGMGLAGGPAQALVMGAAPPDRAATVGSTVQLARSLGFTLGPALATAAWGMAGQDDGVRAGLALAALAACLAVPLLARPARGPANRTEKTTDAAPAAPR

SEQ ID NO: 91 - protein, 267 aa, Streptomyces hygroscopicus
MSAGPALGERELRIDIEDLRVAYAGRTVVADAHLIAAEGEITGLVGPNGSGKSTLLRTVYRHLKPAAGRVLLDGSDIRELSPARSARHIAALPQERGGDFELTVREVVAMGRTPYKRAFAGEDAADRDIVAGALADVGMGDHTDRHFSELSGGERQRVLLARAFAQQTDVLVLDEPTNHLDVRHQVELLALLRGRRRTTLVSLHDLNAAASVCDRLHVLHEGRVVASGTPREVLRPPLLAEVFGVRAAVVEHPLTGDPLIAFDHREL

SEQ ID NO: 92 - protein, 360 aa, Streptomyces hygroscopicus
MALDTTVSRKGTDARVRTRRSMPAGPLALLLAVALLAALTAAVAWGSTSIPPGEVWSVVWRRLSGDAPRPGTNDLIVWQLRLPRALLAALVGAGLGLVGTAMQALVRNPLADPYFLGVSNGASLGAVAAIVLGLGSGGALGLGLSGAAFAGALATFALVWAVARRGGGFAPLRLVLAGVAIGQFLSGFTSYLVLQAGDEQQTHSVLFWLMGSLSGASWPLLAAPAVAVPAVLLLLQARARGLNALLMGDETAAGLGIDVVRLRRELFAVTSLLTGVLVAVSGAIAFVALMVPHVCRLVVGGDHRRLLPVSALFGALLLVVVDIVCRTAMDTQELPVGVVTSLIGAPALLYLLDRRLGSGS

SEQ ID NO: 93 - protein, 358 aa, Streptomyces hygroscopicus
MRSRVWWGTTAAVLGGLLVAGCGDGGGSGGGDKAGPADEKSATGHYPVTVTDCMDAKTTFSKAPEKIVTSNASSLELLLRLGAGDNVIGTGFPPGKGTLPGELDAQARKVKALGQSVIPKEKLLGSGADLYIDTFASMNMGGGMGDAPTEEEFKAAGIKHIYLKSTACAARNKGAVTDLSAVEADITSLGAVTGTSAKAKELVDGMKGKLDAVRKAVGRTAEGERPTYFFFDYDAGTKQPTVVCNRQVANAVITLAGARNVFADCDGDYKQVGWEDVISRNPDWIQLGVRDRGSEAANQKAFDEARKWLESNPATKGLKAVKEGHFLRIGSERTTIGGVENADTVKEIAKALHPGKIG

SEQ ID NO: 94 - protein, 227 aa, Streptomyces hygroscopicus
MSPGRSDSGGGGHVVSTESVLTFAAMSLLVIVIPGPSVLFVVGRALAHGRRTALATVLGNVIGCYALVVAVAWGLGALVESSVALFMGVKLAGAAYLVYLGVQAFRHRREMRVANMDAPADERRGDLRSILDGILVGVTNPKGIVFFAAVLPQFVDHSAGHVPVQMMVLGLVPVTIGLVTDTLWGLGASAARSWFARSDRRLSMVGGAGGLAMIGLGVTVAATGRAD

SEQ ID NO: 95 - protein, 300 aa, Streptomyces hygroscopicus
MDKPTMGRHRRITQPPRSTLATKAALAAGVLVPTIASVGSAHAATPQAAICTSDRPELADKLSEDINSALEGSAATTAISLHDRTTNTTCTLDADRHFDSASTVKVTVLGTLLWDAQKDDRALTQEEKDHATAMITKSDNDATTALWKQLGADKINGFLHAAGMTNTTLDSEGHWGLTQITANDEEKLLQLVTHSNPVLSDDSRAYILKLTGEVIPSQRWGTPAGAPSDAQVHVKNGWLERATNGWRVHSLGAFTGGDHDYTITVLSQDNATMDDGIANIEGIARAVHENLNAPASGAQS

SEQ ID NO: 96 - protein, 263 aa, Streptomyces hygroscopicus
MTMRVPVAGGSLDVRVGGDTGPTLVFAHYWGGSADTWNGVLGHLPPGQATVRFDQRGWGTSRALPGPYHLDQLADDLVRVVEERVSGPFVLVGHSMGGKASQLVAARRPAGLAGLVLVAPAPPQPPAMVTEEYRQGLSHAYDSAETVAHALDHVLTATPLPETVRATAERDSLASGAEARQEWPLHGIARDITDATRRIEVPVTVLAAENDMVEPPHILREHLLPHIPHATLTTVPDAGHLLPAEAPGAVARALGDFLRAIRR

SEQ ID NO: 97 - protein, 294 aa, Streptomyces hygroscopicus
MENGHSAVRQLRYLPAVGSAYGVEVLDFAALRSMDTQRRRTQPQRPDFHVFALVGSGTGSHEADFHNYRLGEGGAVWIRPGMVHRWSDIDACDGPLILFRPGFLSGFTAAEATTPACWHLDRQRLPLALLAAEHLGREHSTAVHTPRLASPALLSHLLAALILRALPGTPPSAEAARPGSRPTEVFRVYRATVEERFAEWHQVADYARALGYDVRTLTRATRAATGTGAKTFLDQRILLEAKRLLAHTDLPVSGCGRRLGFRDVGNFTTFFRRQTGLPPAAWRAAYSTGGTRGV

SEQ ID NO: 98 - protein, 253 aa, Streptomyces hygroscopicus
MLSVNTVTPSHLNAPDQLTEGKYIPGAEIYQGQFSVTVDAVDGKPGLRERKKQRTHAAISDAAISLFLEHGFNQVSVAQVAEAAEVSKRTLFAYFPTKEDLVVHRLADHETESARVVRARPPGTDPLTALREHFLKGLRERDPITGLNDHPAVRRLHRMILDAPSLVARMARFKTGAEHALTEALRETADIPELTARLAAVQIVAVHWALADDNAERVAYGEPADERYAGAVADMEHAFALLENGLRHLPPQQ

SEQ ID NO: 99 - protein, 498 aa, Streptomyces hygroscopicus
MLTESTTEVVVAGAGPTGLMLAYELALAGVETLVLEKLPERIQQVKGGTIQPRTAELLESRGLLEPLLRRAIARGPMGGHFAALPVPLDCTPWRTEHPFPIGIPQWEIEEVLEERATAAGARVLRGAAVSGVAPDDDGVVVTADGLRARAHYLVACDGGHSTVRKLLGLPFPGRAGTHQAVLADIRLSAVSSLVPRQAGHMSTLTRQARGYWSMLVPVGGDRYRFTFGHADQADTARDTAVTHEEIAAALEAVYGPETTLGGVDNSSRFSDATRQLEHYRTGRVLFAGDAAHIHPPLGAQGLNLGVQDALNLGWKLAAVLQDRAPSGLLDSYHAERHPVAAQVLHHTSAQRVLTSPNPSEDVAALRDIITDLLRLPDTNRHLAGLMSGLSLRYDLPGDHPLTGQRMPDADLVTETGTTRLSTLFGSGHAVLLDLAGAVPADLPLPPRVDLVRATCADDLGAAALLIRPDGYVCWATDTTAACGDTLLAALTGDLARVR

SEQ ID NO: 100 - protein, 156 aa, Streptomyces hygroscopicus
MTATADYDSLARRLQALEDKEALRALMIRGWRALDRKDWQTWIECWAEDAVLEFGPWEKIHGKEAVRAKVEEVESPYASMQHHILNMHVDVAGDRATGIGYMWFVAVTEPGSTSSPYSMGGPYDWEFRRGPDGWLLVRQRLGVWWTDGEDTLRAFA

SEQ ID NO: 101 - protein, 6820 aa, Streptomyces hygroscopicus
MLRTDLIRPVPELLRANADRFGDKPACSDGHRTVSHAELERRTRRLAGHLAGLRLHPGDRAMICLGNRVETVESYFGVLRANGVAVPVNPRSTDAELSYLLADSGARLVLTDVAHAEQFDRLREQFPELRVVVSGDGPLPKGFIAFEPLPDTEPDLAARDDLGLDEVAWMLYTSGTTGLPKGVLSTQRNCLWSLAACYVPVTGLTAEDRVLWPLPLFHSLSHIVCLLAATAVGAGTRIVDGVSTSDVLDALREERSTFIAGVPTLYHHLIEAARERDFATPELRIALVGGAVATADLVRSFEATFGVPLVDAYGSTETCGAIAVNWPTGPRVEGSCGLPVPGLTVRLVDPDTGVDVPAGREGEFWVSGPNIMAGYHNQPEATAAALRDGWYRTGDLGRRDEAGFCTVTGRIKELVIRAGENIHPGEVEAVLRTVPGVADAAVVGKPHAVLGEVPVAFVVPGPDGFDPSALLATCRERLSYFKVPEEIYEIARVPRTASGKITRHVLLELPARLRAAGDGQYDSLLRLDWVPHPALPDAPAGTGTWALVDADALGAGLAEGLRAAGVDVADPVADYVADPVADVAGDDGAAPDVVVVAPQVVGLPEEAGVPDEAGVTAGEAADRLAARLGTWLADDRLAGTTFVVATTGAVATGSEENAPEPLSAALWGVVRSLQAAYPGRLTLVDVDDEGGGAGEDGRVAALLRAVQDGHDQAAIRGGVLLVPRLTRISVPAEPGPAPALDPDGLVVITGGDTARGTALARHLVTAYGARNLLLLSANGLPEEAAAALRTELARDGAQVSMAVCDPAERAALDSVLDAQDRPVTAAVHIEEPGPERSLATSLRGMTHLEERTRTAGPALFVVVTSAAGVLGSPGRPDLAAVDQFGEALVRRRRALGLSGLALAWGPLPGEQGTAPVAGAVPLPEALALFDAALTAGQGPLVLLRPSTTGLAGGEPVPAVLRHLVDAPSGVPASDEPAAAEFRRRLAAESESGRRHMALALVREHAAAALGLASADPVEADQAFSAFGFTSLTAVALRNRLNAATGARLAATVVFDHPTPAGLARHLVREITGKRSVRAPVRARGVSDEPVAIVAMGCHLPGEVATPEDLWRLVADGRDAIAGFPEDRGWDLAGLFDSDPDAVGKSYVREGGFLTGAGGFDAAFFGISPREALAMDPQQRLLLETAWETFENAGIDPGSLHGTDVGVFSGVMYHDYGADAGTAAEGLEGHLGVGSAGSVVSGRVAYAMGLTGPAVTVDTACSSSLVALHLAVQAVRTGECSLALAGGVAVMSRPTSFIEFSRQRGLAPDGRCKSFAEGADGTNWSEGVGLVLLERLSDARRNGHEVLAVVRGTAVNQDGASNGLTAPNGPSQERVIRQALANAGLTVADVDAVEAHGTGTSLGDPIEAQALLATYGQERPEGQPLWLGSLKSNIGHAQAAAGVAGVIKMVLAMRHNTLPKTLHAERPTTQVDWSQGAVSLLSEARPWPETGHPRRAGISSFGVSGTNAHVVLEQAPPEVAVPEAEASEAGTPGLVATGGVVPWMLSGKTPAALRAQAERLVSHLESGDAPRAVDVGWSLATTRAALDHRAVILATDTEDGIATARALAEGRPDPLLVTGQTGTDGKTVFVFPGQGAQWVGMGAQLLNTSPVFATRLHECADALAPYTDWSLIDVITGAPDAPSLDRVDVVQPATFAVVVSLATLWQSMGIHPDAVTGHSQGEIAAACVAGHLTLTNAAKIVALRSQIIADHLAGHGGMMSLATPADTIDLTNWHGKLWIAAHNGPNATVIAGDAEALHQLHAHYTDQGTRARIIPVDYASHTGHVDTIKNELHQTLADTTTEPGTLPWLSTVDGEWIEPDTLDSGYWYRNLRQTVQFHTAITTLADQGYRTYIEISPHPVLTTAIQETLETHNTPNAIVTGTLRRDDDTPTRLLTNLAHLTTHGTPVNWPTLFTGTHPTRITLPTYPFQHHHYWLPRNTTTGDVSAVGLQGTGHPLAGAVVSVPDTGGVLLTGQLSVATHPWLADHAVSGTVLLPGAAMAELAIRAGDETATPTLEELVIGQPMTLPEDGALHVQALVGGEEDGRRGVRIYSRPDAAQEQEWLEHASGTLATQPDGSAEGGREDGMAEWPPPGVEPIALDHFYDDLAQAGYEYGPAFRGLKAVWKRDGEVGEVFAEAALPEEQTEAAGRFGIHPALLDAALHASNFCVPPVPGQTLLPFVWNDVRLLAAGATAVRVRARATGPDSFTISLYDSTGSPVASVDSLVLRAISPEQLAAASGGADRSADALFTVDWTEHPTALGTEVSWTTLGDTHTHADVDAAMDALIAGEDRPGAVVADTTAWAAGDTELPTRARDLAARALDLVQRWLAQPELDDVRLVLLTRGAVSVHDTAEVTDPAAAAIWGLVRSAQSEHPGRIALVDTDDASREALPEAVASGEPQVALRRGLLWVPRLVRSSQGLAVPAHEHWYLDVSEKGSLENLVLRPDPEATAPLATGQVRIEVRAAGQNFRDVLVALGGVAGQEGLGGEGAGVVTEVGPGVEGLAVGDRVMGLFPRSFGPLATADARTVAPIPEGWSYATAAGVPVAYLTALYGLRDLGNVQPGETVLVHAAAGGVGMAAVQLARHFGALVYATAHPSKHHVLTALGVPEGHLASSRDLGFASAFPALDVVLNSLTGEYVDASLGLLGTGGRFVEMGKNDIRDPAVVAAAHPGVGYQAFDLGGDAGPDRIRELLTELVELFEAGRIEPLPVRQWDITRAPEAFRWMSQGRHTGKIVLTLPRALDPDGTVLITGGTGTLGATVARHLVTQHGTRRLLLVSRRGPDAPGATDLTTELTELGATVHITACDTADRDQLATTLADIPADHPLTAVIHTAGTLDDGTLTALTPDRLDTVFRPKVDAITHLHHLTHDHDLAAFVIYSSAAGTLGNAGQANYAAANAFLDAFAQWRHARHRPATSLAWGLWSDTSTLTATMDATDVRRTRRAGVLGMDNAEALRVFDTGLRSGRPALVAAKIDLTALRAPDAELSPLLRGLARPARRTARTAAPAAGGLSGQLAGLSPAGQREFLLNLVRAEAAVVLGHTGPEAIEPTVAFKEMGFDSLTAVELRNRLNAATGLRLPATLLFDHPTPALLTELFHTELGGGPAPAAAAPVTVRAAADEPIAVVAMSCRLPGGVTDPDGLWNLLLGERDGITDFPRDRGWDLEALFDADPDRSGTSYVLRGGFLEDAAGFDADFFGISPREALAMDPQQRLFLEACWEVFERAGMDPTAVGGGDIGVFAGVINQDYGVRSGPAPEDLEGYMLTGSATSVASGRVAYVLGLEGPAVTVDTACSSSLVAMHWAVQALRQGECSMALAGGATVMGRPSAFVEFSRQRGLAPDGLCKAFGAGADGTTFSEGVGVLLLERLSDARRNGHEVLAVVRGTAVNQDGASNGLTAPNGPSQQRVIRQALANAGLSATDIDAVEAHGTGTALGDPIEAQALLATYGQDRPGDEPVWLGSLKSNTGHTLAAAGVSSVIKMVLAMRNGTLPRSLYADEPTPEVDWSQGAVSLLTEARPWPETGHPRRAGISSFGISGTNAHLILEQAPQPEPQAETDPEPEAAPKADDGMATPGLVATGGSVPWVLSAKTATALRAQAQRLLDHLESGVTDRPLDIGWSLATTRTLHDHRAVILTDTEGADATAALTALATEQPHPRLTTGHATTHGKTVFVFPGQGAQWAGMGAQLLDTSPVFATRLHECAKALAPYTDWSLIDVITGAPDAPSLDRVDVLQPTTFAIMVSLAALWQANGIHPDAVIGHSQGEIAAACVAGHLTLTNAAKIVTLRSQTIAHHLTGHGAMMSVLASPTWVQETLAPWHGHLWIAAVNGPASVSVSGDPDALAEFGTTLSKAKVYRWQLPGVDFAGHSGHVDTIKDQLHNVLDGITATPGHTAWMSTVDADWANPTHIDPDYWYRNLRDTVRFEEATRALLTQGYRVFIEVSTHPVLTTAIQDTTESLPDTPTTITGTLRRDDGGPDRVLTSLAELSAAGIPVHWPTAYAGTTPSQVPLPTYPFQHQHYWLAATGHHGDVGSVGLRDAAHPLLGAVVSVPDTGGVLLTGRLAPSAQSWLADHMLSGVALVPGTAIVELAVRAGDETGTPVLEELVLGQPMLLPEDGSLQVQVLVGAAEDDERRTVRVYSRGDESEPWVEHASGILSAQALIPVEAERQWPPAGAEPVALEGFYDRLAEAGYEYGPVFRGLTAAWTRDGDVFAEVTLGEEQHDLARRFGIHPALLDAALHASNFCPGNEPGGGTYLPFSWNGVQLHADGATALRVRVTSTGPDNLSLYATDPHGVPVVTVGSLVLRETTAEQLRTTSASSTADSQFTVEWTEHALARDEVAWAALDAVPDQDTWPPVVVADTRAYTAEGGELPERARALTCRALAAIRRLISDDALADSRLVLLTRGGMAVHDDTEVTDPAAAAVWGLVRAAQAEHPGRVCVIDTDDRSAEALPAALATEEPQLALRGGIAWVPRLVRARPGLAVPATAAWHLDVTEHGTLENLALVPHPRAEAPLEAGQVRIAVRAAGQNFRDVLIALGMYEAEIGTEGAGVVTEVGPGVADLAVGDRVMGMLPGSFGPLVVADRRTVVRMPRGWSFTAAAGVPVAYLTALYALRDLGDVQPGETVLVHAAAGGVGMAAVHLAHHFGATVLATAHPAKHHSLEQLGVATERRASSRDLAYAHTFPTTDIVLNSLTGEHIDASLRLLNPGGRFIEMGRTDIRDVDEVAATHPDRTYRAFDLGADAGPDRIQELLVELVDLFEQGLIPPLPTRPWEITRAPDAFRWMSQGRHTGKIVLTLPRTPDPDGTVLITGGTGTLGTAIARHLVTHHGVRNLVLTGRQGPNAPGAADLHDELTALGAQVRITACDSADRGQLAALLAGIPSDHPLTGIVHTAGTLADGTLTTLDPDRIDTVFRPKVDAVTHLHDLTRDQDLALFAVYSSAAGILGNAGQANYAAANTFLDAFVQQRRAAGLAGLSLAWGLWAETSELSAALITANRDRTRHGVVRPMTTEHALSLFDSALGLGLPLVVPAKLDPGAHESAAGAVSPLLTGLVRPTRRTLRSTSGQSGEGGLTARLAALSEADQHRLLLDLVRDHTATVLGHTGKDAVDARRAFSDIGVDSLIAVELRNRLAGATGLRLPATVVFDYATPEAMAGHLRSVVAGDTAAPASPSTSAPASAVAPADDPVAIVSMNCRLPGKVTGPGELWDLVSQGRDAIGPFPTDRGWDVETLFDLDPDAVGKSYVREGGFLTGAGDFDAEFFGISPREALAMDPQQRLLAETSWELFEQAGIDPMSVRGQAIGVFAGVIDQGYIAHSEAPPPELEGYLMTGSTTSVASGRVAYLLGLEGPAVTVDTACSSSLVALHLAVQALRAGECSMAITGGVTVIAKPGGFISFSRQRGLAPDGRSKSFSEGADGTTFSEGIGLVLLERLSDARRNGHEVLAVIRGTAVNQDGASNGLTAPNGPSQQRVIRQALSNAGLTVADVDAIEAHGTGTALGDPIEAQALLATYGQDRPGDEPVWLGSLKSNIGHTQAAAGIAGLIKMVLAMRHGMLPPSLHAGEPTTKVDWASGAVSLLSEARPWPETGHPRRAGISSFGISGTNAHVILEQGPEVAVPEAETGAPGLVATGGVVPWVLSAKSPAGLRAQAERLVSHLESGDAPRAVDVGWSLATTRAALDHRAVILATDTEQGTATVRALAEGRPDPLLVTGQTGTDGKTVFVFPGQGAQWVGMGAQLLSTSPAFATRLRECADALAPYTDWSLIDVITGAPDAPSLDRVDVVQPATFAVVVSLATLWQSMGIHPDAVTGHSQGEIAAACVAGHLTLDAAAKIVALRSQIIADHLAGHGGMMSVLASREQVEEALTPWQGKLWIAAHNSPQATVVAGDIDALHELHAHYTDQDIRARIIPVDYASHTGHVDTIKNELHQTLADTTTEPGTLPWLSTVDGEWIEPDTLDSGYWYRNLRQTVQFHTAITTLADQGYRTYIEISPHPVLTTAIQETLEANDTSNTTITGTLRRDDDTPTRLLTNLAHLTTNGHTPDWTALYSATHPHPTPLPTYPFQHHHYWLTPSEVPEAVADGVFWETVERGDLASLADSLGVEEKALEPVLPGLTSWRRRNQDQSTVDAWSYRIAWDPVASGEAPVLPGAWLVAVASPQTSDTAVTGVIAALAAHGADPVVVEVDTVERAEVTALLRERMSGSDDEYAGVLSLLAWDERTCEPGTLSRGVAATVALMQAVEEIGLTAPLWCLTRGAVAVREPSEVTSEFQPLAWGMGVVQGLDQPSTWGGIVDLPRTPDDTALARLCSVLAGVDAEDQVAVRASGVFARRMRREPVTSAPAWQPRDTVLITGGTGGLGSYVARWAAGHGARRVVLLSRQGAQAAGAAELEAELTALGADVTIAACDVTDRDQLAAVLAEIPDDVPLSAVVHAAGLALPEKPLSKMTLAEFADIGRAKIAGARHLDDLLGERELDAFVLFSSGAAAWGSGGQSAYAAGNAYLDGLAQRRRARGLAATSVAWGAWGGGLGTIDEAMGAQWRRTGLMTMDPRLAALAMAHTVGSGTAHGVVADIDWERFAPGYTLARFRPLLRGLPDVIDLLTEDTHEDGAGQTELIARLAGLSPGDQERLLTELVQAEAAAVLGHASADATGDRPFSEIGFDSLTAVELRNRLNAGTGLKLPATMVFDHPRPSALARRIRTELGQTDTSSVDSVLAELERLEAHLAALPKEKIERARITSRLQRMTTKVAEIEANGAGGETVTERLDTANADDVFAFIDQEFGVD

SEQ ID NO: 102 - protein, 3431 aa, Streptomyces hygroscopicus
MANDEKLLNYLKRVTADLHQTRERLRKAEAATEEPIAIVGMGCRFPGGVTTPNGLWDLVADGRDAIAGFPEDRGWNLENLFHADPDSVGTSYVREGGFLADAAEFDAEFFGISPREALATDPQQRLLLETAWETLEHAGIDPSSLADSDVGVFTGLANGDYALTVDQVPEGFEGYLGLGGAGSIASGRISYSLGLLGPAVTLDTGCSSSLVAMHLASYALRSGECSMALAGGVMVMATPGGFVGFSRQRGLARDGRCKSFGEGADGTNWSEGAGLVLLERLSDARRHGHEVLAVIRGTAVNQDGASNGITAPNGPSQERVIRQALANAGLTVADVDAVEAHGTGTSLGDPIEAQALLATYGQNRPEDQPLWLGSIKSNIGHTQAAAGVAGVIKMVQAMRHGVLPKTLHADEPTTKVDWSQGAVSLLSEARPWPETGHPRRAGISSFGVSGTNAHVILEQAPPEVAVPEAEASETGTPGLVATGGVVPWMLSGKTPAALRAQAERLVSHLESGSDANPVDVGWSLATTRAALDHRAVILATDTEDGIATARALAEGRPDPLLVTGQTGTDGKTVFVFPGQGAQWVGMGAQLLNTSPAFATRLRECADALAPYTDWSLIDVITGAPDAPSLDRVDVVQPATFAVVVSLATLWQSMGIHPDAVTGHSQGEIAAACVAGHLTLTNAAKIVALRSQIIADHLAGHGGMMSVLASREQVEEALTPWQGKLWIAAHNSPQATVVAGDIDALHELHAHYTDQDIRARIIPVDYASHTGHVDTIKNELHQTLADTTTEPGTLPWLSTVDGEWIEPDTLDSGYWYRNLRQTVQFHTAITTLADQGYRTYIEISPHPVLTTAIQETLEANDTSNTTITGTLRRDDDTPTRLLTNLAHLTTHGTPVNWPTLFTGTHPTRITLPTYPFQHHHYWLPRNTSTGDIASAGLHDPAHPLLTAAVHLPDTGGTVLTGRLSLTTHPWLADHTVSGAVLLPGAAMAELAIRAGDETATPTLDELVIEQPLALPDSGFLDIRVVVGGPDEAGRRDVRIYSRAAEESAQWTVHATGTLAQDTTAPPSPTAAEWPPAGAEPVAVEGLYEQMAEGGYDYGPTFQGLKAVWTRDGDVGEVFAEAALPEEQTEAAGRFGIHPALLDAALHASNYCLPGEPGGRMLLPFAWNDIRLHATGATSVRVHARYTEDDGLSEVLVDTAGGLVASIGSLVLREVDAAQLEALASTSVNDALWTVTWTEHTATTDEIRWGTLGDVSPVLAAAEAPAFADVTEIATAPATEIAGTEDRPALIVADTTAWQSRDADPITRARELATRALDLLQRWVTLPELSETRLAVLTRGAMAVHDSAEVTDSAAAAIWGLVRSAQSEHPGRIQLIDADGHSDHTLRSALSTALTTDQPQLALRDNTLWAPRLTPTTPADTPAQPLPLNPEGTVLVTGGTGTLGALTARHLITHHGARHLLLISRQGPDAPGATDLTTELTELGATVHITACDTADRDQLATTLADIPADHPLTAVIHTAGTLDDGTLTALTPNRLDTVFRPKVDAITHLHHLTHDHDLAAFVIYSSATGTLGTPGQANYAAANTYADALVHQRHAAGLPATSLAWGLWETTSALTATMNTEDRRRTHRGGVAALTDDEGLALLDRALTATHHPHLVPIKISPASLRADDTAQPVPPLLRHLVRRPTRRTAHTPAPADTLSLAQRLAALDQGERLRHLTELVRTEAAAVLGHTTIDSIGPDQPFRDVGFDSLTAVELRNRLNAATGLRLPATVVFDYPTPAITAGYLRDELFGPAEAAPAAVAGPGADADDPVVVVGMACRLPGRVTDPDGLWRLVADGEDGIGAFPTDRGWDLDTLFDPDPDRVGATYVREGGFVAGATEFDADFFGISPREAVAMDPQQRLLLETAWETFEQAGIAPRSVQGSDTGVFAGVIYHDYGTNAGELPEGSETYLSTGKSGSVVSGRVAYALGLTGPAVTVDTACSSSLVAIHWAAKAVREGECSMALAGGVTVMSTPDGFVSFSHQRGLAPDGRSKSFGEGADGTTFSEGVGLVLLERLSEARRNGHEVLAVVRGTAVNQDGASNGLTAPNGPSQQRVIRQALSSAGLSATDIDAVEAHGTGTALGDPIEAQALLATYGQDRPADQPLWLGSLKSNIGHTQAAAGIAGVIKMIQAMRHGMLPRTLHADEPTTKVDWTSGAVSLLTEARPWPETGHPRRAGISSFGVSGTNAHLILEQAPEEAATAPETTEPEAPGLVATGGAVPWVLSAKSPTALRAQAERLIAHLHAHPETDPVDMGWSLATSRAALEHRAVVLATDLDQATAALTALSEGQPHPSLITGETGSDGKTVFVFPGQGAQWAGMGAQLLDTSPVFATRLHECAEALAPYTDWSLIDVITGAPDAPSLDRVDVLQPTTFAIMVSLAALWQANGIHPDAVIGHSQGEIAAACVAGHLTLTNAAKIVTLRSQTIAHHLTGHGAMMSVLASPTWVQETLAPWHGHLWIAAVNGPASVSVSGDPDALAEFGTTLSKAKVYRWQLPGVDFAGHSGHVDTIKDQLHNVLDGITATPGHTAWMSTVDADWANPTHIDPDYWYRNLRDTVRFEEATRALLTHGHRVFIEVSTHPVLTTAIQETTETLPEVRATITGTLRRDDGAADRVLAGLGGLFAAGVPVDWGALFAGTGARRVPLPTYAFQHRHYWLEPARTPTRAETADGSLWAAIEDGDTQSLARDLEVDAAALGTVLPALASWRRRSREDSLTDAWRYRIGWTRVAAADPQMSGRWLVLVPAVRAGSARVRAVLDGLAARGAEVVAAEVSETGREALGDQVKSADGGAGVVSLLSWDDRADTEYGTVSTGTAATLAAAQALRDHGITAPLWCVTSGGVAVAGETADPVQSAVWGFGAVLGLDHPDTFGGLIDLPAEREGDGEALPDGLFAALSSPEGEDQLAVRADGLFARRMVRDRDGSGSLWKPRGTVLVTGGTGGLGSHVARWLATSGADHVVLLSRQGGDAPGAAELVADLAGVQVTLAACDVTDREAVAAVLAEAERTHPLTAVVHTAGAGLPSAPVTEVTAEEFAAVTGAKVRGALVLDQLVGDRQLDAFVLFSSGAGVWGSGGQAPYAAGNAFLDGLAARRRAHGLAATSVAWGGWGGGLGMIDADGGDQWRRIGILPMDPAPALRAMARAVGSGLPNAIVADVDWARFVPGYTMARERPLLRQLPEVAEILAADARGGGASRREVLLGSLAELTGPEQEVFLTDLVRREAAAVLGHADGDAVEPERAFKDTGFDSLTAVELRNRINAATGLQLSPTVVFDYPKPTTLARRLRTELVPAVNGDANGGMDGDGTADGGAVGAEGRERQIRRVLASVPLRRFHELGVLDALVRLADSAAGDPSGLRDLGDLDTAAEAETSALAELDADELVSRAMRGTTFGNH

SEQ ID NO: 103 - protein, 3868 aa, Streptomyces hygroscopicus
MAASREDLVKALRTSLMDAERLRRENDRLIAESTEPVAIVAMACRLPGGVTDPESLWKLVDEGRDAIGPFPTDRGWDLETLFDADPDAVGKSYVREAGFLEGAGGFDAAFFGISPREALSLDPQQRLLLETAWETFERAGMDPRSVEGRDIAVFAGGSGQGYGGGPGDAPKGLEGYLGVGASGSVISGRVSYTLGLTGPAVTVDTACSSSLVAAHLAVQALRSGECSMALAGGVAVMGQPTAFVEFSRQRGLAPDGRCKSFGEGADGTTWSEGVGLVLLERLSDARRNGHDVLAVIRGTAVNQDGASNGLTAPNGPSQERVIRQALSNAGLTVADVDAVEAHGTGTALGDPIEAQAVLATYGRKRPADQPLWLGSLKSNIGHAQAAAGIASVIKTVMALRHGRLPKTLHAEQPTSQVNWTSGAVSLLTEARAWPETGHARRAGISSFGVSGTNAHVILEQAPEEAEATGENTAGQEPSVRSAESADPGPVATGQVVPWVLSGHTREALRAQAARLLTQVRETPADGLRDVGWSLATTRTRLDHRAVVLCADAEQAVAGLEAVASGASARSAVSGSVAAGKVAVLFTGQGSQRAGMGRELHGGYPVFARAFDAVCAQFGDLPDGDDKVSLAEVVFAEEGSARAALLDRTEFTQPALFALEVALFRLVESWGVRPAYVLGHSIGEVAAAHVAGVLSLPDACTLVRARGRLMQRLTATGAMVAVEAAEDEVAPLLAGKEHKVSIAAVNGPTSVVVSGDEDVVTAVAETLARQGRKTKRLVVSHAFHSPHMDGMLDAFREVASRLTYAPPRIPVVSNLTGTVAEPGELCSPEYWVRHARGAVRFLDGVRTLADQGVRTHLELGPDGVLTAMGQDCLPEADAAFVPSLRPGVQEPHAVLAGLAGLYVRGVRVDWDAMFAGSGARRVALPTYAFQHEHYWLERAAGSGDVGAVGLGEAGHPLLGAVVQLPETGGVQLSGRLSVRAQPWLGEHVISGAVLVPGTAMVELAVRAGDETGTPVLEELVIGQPMVLPGDTALSVQVVVGADEGGRRTVRIYSRTDGGSDWTEHATGTLAAQGPAPLDGGAYGAGDGAAVQWPPAEAEPIPVEDFYRSLVDAGYAYGPAFRGLVAAWRRDGEIFGDVALPEASVAEAERFGIHPALLDAALHAGSFCLPSDPARQVTLLPFAWNNVRLHAGGASAVRVHVRPVGDDAFSVRLTDGSGQTVASVDSLTLRAVDPAQLEIGTADDALWTVRWSETSLPDGAISWAALGDPATGGAGAMGDTGSAGGALPDVLVADTRAWAEDLTGPPTARARRLTGRLLAEIQRWVADDAMAGTRLAVVTRGAVAVRDDAEVTDPAATAVWGLVRSAQAEHPGRVALVDADGVCEELPAGVWSGEEPQLAVRGGAVWVPRLARVEPGLRVPAQASWHLDSAEYGTLDHLALLPDEAEPAPLEAGQVRIEVRAAGLNFRDVLVALGMYPGRSVIGTEGSGVVTEVGPGVAELAVGDRVMGLFSGSFGPLATADAHTVIRMPDGWSFGTAAGVPVAYLTALYALQDLGSVQPGETVLVHAAAGGVGMAAVQLAQHFGATVLGTAHPSKHHALHRLGVPAERLASSRDLGYAAAFPTADVVLNSLTGEHIDASLGLLNPGGRFLEMGKTDLREPGEVGARHPEVTYRAFDLGGEAPAERVRELLHQLVELFEAGRIEPLPVRQWDITRAPEAFRWMSQGRHTGKIVLTLPRALDPDGTVLVTGGTGTLGATVARHLVTQHGARRLLLVSRRGPDAPGATDLTTELTELGATVHITACDTADRDQLATTLADIPADHPLTAVVHTAGTLDDGILTALTPDRLDTVFRPKVDAITHLHDLTRDQDLAAFVVYSSAAGVLGGPGQGNYSAANAYLDGLAQWRRAHGLPATSLAWGMWAQTSGMTAGLGSGDLHRVRRGGIVGLSTAEALDLFDRSVASGLSLLVPLRFDLAALGAEAAEPPPLLRGLVRPARRTARPVPKAGEGGLVERLAGLSAAEQERLLVELIREQAASVLGFPTVDPIGPEQAFRDMGFDSLTAVELRNRLNTATGLRLPATLVFDHPTPLATAELLRDELGGRAVEATPRPARRDRSAPDAAEDPVVVVGMGCRLPGDVRTPEDLWRLVAAGTDAIGPFPQDRGWDLAGLFDSDPDALGKSYVREGGFLTDAGGFDATFFGISPREALSMDPQQRVLLETAWETLERSGIVPTSLRGQEVGVFVGASGQGYGTGPGAAPEGLEGYLGVGGATSVASGRLSYTFGLTGPAVTVDTACSSSLVALHLAAQALRSGECTMALAGGVAVMGQPGAFVEFSRQRGLASDGRCKSFGEGADGTNWSEGAGLVLLERLSDARRNGHEVLAVIRGTAVNQDGASNGLTAPNGPSQQRVIRQALSNAGLTVADVDAVEAHGTGTALGDPIEAQALLATYGQDRPGDEPVWLGSLKSNIGHTQAAAGISSVIKMVLAMRQGTLPRSLHADEPTTQVDWTSGAVSLLTEARPWPETGHLRRAGISSFGVSGTNAHVVLEQAPEAAAPQADEADDIPGLVATGGIAPWVLSAKTPTALRAQAQRLLDHLESGVDGRPLDIGWSLATTRTLHDHRAIILTDTDTDTRAEGGEATAALTALVTGQPHPRLTTGYATTQGKTVFVFPGQGSQWVGMGAQLLDTSPVFAARLRECADALAPYTDWSLMDVITGAPDAPSLDRVDVVQPATFAVVVSLATLWQSMGIHPDAVTGHSQGEIAAACVAGHLTLTNAAKIVALRSQIIADHLAGHGGMMSLATPADTIDLTNWHGKLWIAAHNGPNATVIAGDAEALHQLHAHYTDQGIRARIIPVDYASHTGHVDTIKNELHQTLADTTTEPGTLPWLSTVDGEWIEPNTLDSTYWYRNLRQTVQFHTAITTLADQGYRTYIEISPHPVLTTAIQETLETHNTPNAIVTGTLRRDDDTPTRLLTNLAHLTTHGTPVNWPTLFTGTHPTRITLPTYPFEQETFWLDRSGPGDVRAVGLEDTGHPLVGAVVSVPDTDGVLLTGRLSLTTHPWLADHAVSGTVLLPGTAMVELAVRAGDEAEARVLEELIISRPMAVPDEGTLHVQVLVGGEEGDEGGRRKVGVYSRPEGIRQWTEHATGTLLTGGTATAAATTAHPWPPEGAEPVALEGFYEQLAEAGYEYGPAFRGLSAVWKRDDEVFAEVAVPEDQTAVAGRFGIHPALLDATLHAGNFCFESGGDRPTMLPFAWTDVRLHAVGATAVRVRATASGTDGLCVQITDPHGLPVATIGSLQLRETTPEQLRALSATSGGNALWAVEWAECGLDDTTEAQWATLGESQLLDSPLHYADVSQVVAAGEQPAALVADVSAWAPENTGPPIDRAHALCARVLDLLRQWVDRPEPADTRLVILTRGAMAVHDTAEVTDAAAAAVWGLVRSAQSEHPGRIQLIDIDEHSHRTLPTALTTTDQPQLALRDATAYTPHLAPAPTPTPGPLTLAPEGTVLITGGTGTLGALTARHLITHHKARNLLLVSRQGPDAPGADRLSEELTQLGARIRIAACDVADRDQLATVLATIPADQPLTAVIHTAGALDDALLTDLTPERLGTVFRPKVDALTHLHDLTRDHDLAAFVIYSSATGALGTPGQANYAAANTYADALAQQRHAAGLPATSLAWGLWETTSALTAGMSTTHQQRTRHSGVIPLTDADGMRLLDTALTTHQPHLIPLKLDRTALRNSAASHTLPPLLRTLAQSHHRPTAHTTPRTAAAPPLPEQLAALDPAQRLQHLTAFVRAEAAAVLGHATSDAVGPDDPLFEIGFDSLTAVELRNRLNAATGLQLPAALLFDHPTPAMAAEHLQEQLALKDAS

SEQ ID NO: 104 - protein, 685 aa, Streptomyces hygroscopicus
MLVLGLNGNFSAADTDVVPQLGEVFFHDSAASLIRDGELVAAVEEERLNRIKKTTKFPLNAVRECLALAGARPEDVDAVGYYFPENHIDTVLNHLYTEYPRAPLRYSRELIRQRLKEGLGWDLPDEKLVYVPHHEAHAYSSYLHSGMDSALVLVLDGRGELHSGTVYRAEGTHLEKLADYPVPKSLGGLYLNATYLLGYGFGDEYKVMGLAPWGNPETYRDTFAKLYTLQDNGEYELHGNIMVPNLVSPLFYAEGFRPRRKGEPFTQAHRDFAAALQETVEKIVLHILEYWAKTSGQSRLCFGGGVAHNSSLNGLILKSGLFDEVFVHPASHDAGAGEGAAYAAAASLGTLERPSKRLLSASLGPAMGGREQIRARLADWAPLIDVEFPDDAVETAAGLLAEGQVLGWAYGRSEFGPRALGHRSIVADARPEENRTRINAMVKKREGFRPFAPVVTAEAARDYFDLSGADGNHEFMSFVVPVLPERRTELGAVTHVDGTARVQVVSAESGERFHRLVRRFGELTGTPVLLNTSFNNNAEPIVQSLDDVVTSFLTTDLDVLVVEDCLVRGKPAPDLGVLVPRFRPVTRLVERRTAGPDASAGARTHEIHLDYDGGPSAKVSPELYELLGAVDGTTTLGDLAKTVGGLSEALATEVFALWEQRFLTLAPAGDLPTGHGPADDGARGR

SEQ ID NO: 105 - protein, 370 aa, Streptomyces hygroscopicus
MTEGKPVSEPPTAVKCLVWDLDNTLWRGTLLEDGEVLPFEWVRDVITTLDERGILQSIASKNDHDHAWERLEALGLAEYFVLPHIGWGPKSASVRAIADRLNFADRAMAFVDDQPAERAEVAYRLPEVRCYPAEDLAGLTGLPEFSPAVVTVDSRQRRNMYQSGFRRDAERAEFSGPDEDFLRTLDIRMGISRATERELSRVEELTLRTSQMNATGVHYPDSVLRGLLTDPAHEVLVITMADRFGPHGAVGIVLLERHPAVWHLKLLATSCRVVSFGAGSTLLNWLADQAAQAGVHLAADFRRTDRNRMMEVAYRFAGFADTTCACTAALAAPDEEGVERLHLTPAFQPAPTTLRLTAPELADPALPRSR

SEQ ID NO: 106 - protein, 370 aa, Streptomyces hygroscopicus
MTDAATSHTELVSGLIGDRADAWDLAGELPRDLLVKLGASGVLCAQVGAEHGGAGLDSRANGELTAAVGARCSSLRSVMTSQGMAAWTVRRLGGAEQWSTFLPRLTSGDLAAVGFSSPGAGSDLAAMETEIADDGTHVVVTGRKVWITAAHYADLLVVFGKYRGGAAAVVVPARAPGVSITRVPDPLGCRAAGHADITLDAVRVPTGQVLGGTGLPLPLVTTAALTYGRMSVAWGCVGILRACLDAAATHTATREQSGRRLAEHQLVARHLAELYVAERHATRACEHASASWDTGSPDMAVDAVHAKYVASREAADGAARAVQLLASAAASDGHVVARAYRDAKLMEVIEGTSEICQLVLAQHTRKKVQA

SEQ ID NO: 107 - protein, 91 aa, Streptomyces hygroscopicus
MTISSEPGSHTAETVAQEVQQFLEQRTKQTWDPDTDLFSSGAVSSMFAMELVVHLESTFDVVITGPDLALDNFRTVNAMTAMVLRLRGVQP

SEQ ID NO: 108 - protein, 288 aa, Streptomyces hygroscopicus
MSGDAEAPRLTVLGAGTMGLGITSLAVGHGIPVTVVEVDEAKAGRTRAAVTERLRMAQLMGALPAGRPRGELTVTASLADGRNATAVVEAVTEDTPTKAKVLEAVAGLTGARVPLISNTSSIPIDELAGHIADPARLVGTHFMNPPYLIPTVEVIRGPRTGEAVMTAVTDLLRALERKPVVVGDGPGFVTSRVLHPMINDAIRVVQEGTATVEAVDVLMRDCLGHRTGPLRTADLIGLDNLADSLRVLHERTGDSRCAPSELLLKKVRDGHLGRKSGRGFYAYGKELA

SEQ ID NO: 109 - protein, 218 aa, Streptomyces hygroscopicus
MAQQVDVTEKILGYVRELSLRDDEILAGLRAETAGLPAAQAMQVMPEEGQLLGLLVRLVGARSVLEIGTFTGYSTLCMARALPTDGTLVTCDITAKWPGLGRPFWERAEVADRIDVRIGDAKETLAGLRREGREFDLVFIDADKTGYAHYYEESLAMLRRGGLIVLDNTLFFGRVTDPAAQDADTAALREVNKLLREDGRVEISMLTVGDGITLAVKR

SEQ ID NO: 110 - protein, 926 aa, Streptomyces hygroscopicus
MPYSYAMPVNTERNSRPLGGVLNTAVHLGHPFGDSLVRPGEALLVDGPLACGKTTLLRSFAERASESGYLTITATCSPSERDLPFGVVSQLARGAWKSPGGPPEVPGLPDILRGAGDPVDRAGIARLCHRLCTSLIDHAEHTPLLLAVDDVRHSDPASAAFLLQLVRRLDSARIAAVFTDDLSLSSSLPLRYELLRAQHLRRIGLGPLSPGQVAEVVVAELGETARRHVGDILAATGGNRLLLHTLLSDYREYGEARQTGYGQSFLSCLHRNEPIFLDVVRALAVVGSALPAADLAWLTGHEPEPISQVLAALTGAGLMDEGAFRQETARLSVLNDMPAQARRTLHQRAARLLHDQGRPAATIARHLVRAGQIPDSWSAEVLLEVAEQVAVGEEASIAVDLLEQSFEQCPHEERRAALRAKLAEAEWKINPSTATRHHAPLYGAVRAGRLGLPDSVTLLMQLLWKGGLSEVEGLLAHLRADPAATDQLHAIEAALTCTYPWLAERRAAPPHHGGAAATRAAAWPRAGTVLADVLTGGQTHDTVRRAEEVLRELQLGHDPACHEQAGLFALLALVYGGRNDLASAWCEGALGETGGGPHVPMRQAVLSAARSEIALRRGDLAEAAEQSRAALTHASPGAWGVAIGLPLGALILACTRMGRHEEAGFHVAQTVPNAMFKSSYGLHYLYARGHYFLAAGRHQAALADFLLCGELLTDWGLSSGCDPVPWRIGAAEAWLAQGNHDQARILVYQQLSRPHTDGARARGQSLRLLAATSSAKRRPQLLNEAVGLFTEQEDKYELARTLWDLSQAYHALGEKKQARRTMRRAWHVAKMCDAASLYEEWLPADDQGHATGPTPKSDTAIERLTHSERRVASLAAMGYTNREIAGKLYVTASTVEQHLTRVFRKLDIKHREQLPTELYADRMELA

SEQ ID NO: 111 - protein, 354 aa, Streptomyces hygroscopicus
MTTSTSTSATGSASPARQVTVGLAERSYTVHIGHGVQRLLPQVVAALGARRAVVVTARPAGQTPDPGVPSLVVPARDGEEAKDLAAVTDLCRRFVGFGLTRSDVVVSCGGGTTTDTVGLAAALYHRGTPVVHVPTSLLAQVDASVGGKTAVNLPEGKNLVGAYWQPAAVLCDLEHLKTLPDREWRNGLGEIARCHFIGAPDLDGLPLLDQISASVTLKAGIVAADERDSGLRHLLNYGHTLGHALERATGFALRHGEGVAIGTVFAGRLAGALGRIGPERVAEHHDVVSRYGLPTGLPPDVSVSELVELMRLDKKATDGLTFVLDGPEGPGLVRGIPEDTVSTTLAAMPRAPAW

SEQ ID NO: 112 - protein, 64 aa, Streptomyces hygroscopicus
MKVSVDQDKCCAAGHCALAAPEVFDQREEDGTVVLLDARPPLELRDSVAEASFLCPAAAIAVED

SEQ ID NO: 113 - protein, 397 aa, Streptomyces hygroscopicus
MDEIRDYPELRAAACPFSPPPGYEELRERSAVTRVRMWDGSTPFLVTGYHEARAALGDSRFSADGTHKAMPRFVKFEVPAEVFNLGRMDDPEHARIRRMLTANFTIRRTEAMRPMIQGIVDGLLDRLIAQGPPADLVADFAFPLPSQVIGVMLGVSDADFAEFQQASQGVMDFTASAEEMGAALGVMVDYVTRMCAAKRADPGDDLLSRLIVDQEPTGGLTQQQVVATALVLLLAGHETTANMIALSTVLLLNHPDQLARLRADAGLMGNAVDELLRYITIVQEGTGRVAVEDVEVGGVLIPAGEGVIINLPSANRDPHFADAHELDLSRPNAREHVAFGFGVHQCLGQTLARVELQIALETLLRRLPTLRLEVPLEDLAFLYESMNFGVARVPVAW

SEQ ID NO: 114 - protein, 947 aa, Streptomyces hygroscopicus
MSMGLTDYQSELRGVLDMAARGNGGLLKVTGGPGVGKTSLLGSLKEQAAESGAVCLMASGFADDTAIPFNIVEQLIWSSAFTDELDVVARWRTAGERYSEAEPGILRSLVREISDVLHRIAGGKQLIIAVDDAEHADYPSLMCLLHIARHASGTRTLVVMTCGQSHQLCVGTHGFHELYKIKIDTLPESGVGHLLERHGDADLADRIRASCHAVSGGNPRLVKALLRDHLQAAPGGSETDVTVGAEFQETYRGCLLSHPALLQVAQALAVLDRYGGPGRVASLLACGRERATRAITVMNSAGLLEDGRFRHPAARYITLETLSAEDRARLSAKAAELLYADGADPIAVAELLVTADRTPDQKDVTVLWHAAQKNLDHGRTEEAIAGLRLAARADLGRREHMDILMALVGALWSSNPATAEPELDRLMAAIREEFPADIPEQYLCFLLFMVLWFGRFSDGEEAFKWLSGGGDTDNASSMAALRVTRQWATFLKPALIHDFPDQASSAGEVDGLWAANLEHGLQLSVDELGMEIGHFQDPRQVADFSPDTMHLLSPSNHFWFAYAYACRMVWALAARGEAETADRLCGALFTAAGNLNMKTPGAVALAMRAYIRCRHGDFTSAIDLAGTALKSIPPRGWGVAIGLPLSVLVAAHTAIGRLDEAQRYLHYWVPKEMFDSVVGLEYLRARGQYCLATNRPYAALNDFMVSGMLMDQWPVDFGDLAPWRIDAAEAYLRVQEPAEAKRLALEELKLSPDRPLSTRGRALRVLAMAEDPDKRRLLLYQSAKCLREHGDRFELARTLAELSQDFLSTGETQQARGTWHEAQKLMDECGISAQHESRRDLVVDGAESPADARLPEPAGDTGEPEESDPAASAEGAEQPVLSEAEWRVATLAASGMSNRQIAKSLYITVSTVEQHLTRIYRKLSVGNRQELSRRLWQLIGATGSSSC

SEQ ID NO: 115 - protein, 550 aa, Streptomyces hygroscopicus
MAGEPAAVAVVTDLAIGGMTCAACVKRVEKKLARLDGVTASVNLATGRARVNHPPEVGPDQLIATVEQAGYTAALPEPPAKERREDGDEARDARQERDRLLSTALLAVPVLVLSMVPGLQFRNWQWLCFVLAAPVAVWGAWPFHLRAARGLRHSAATMDTLVSLGVAASFAWSSYALFFGGAGDPGMRMPFSLVPTASDGVAHIYLEAAVGVPLFVLAGRFLETRARRGTGVALRALARLAAKEVSVRDGDGERLVPIEELRVGQVFVARPGERLATDGTVVEGSSAVDLSLVTGESEPVEVGPGTPVIGGAVNAGGLLLVRATAVGADTQLSRITRLVTEAQAGKARAQRLADKAAGVFVPVVLTLAVTVLGFWLGAGAEPQAAITASVAVLVVACPCALGLATPTALMAATGRGAQLGVLVSGPQALEGLRHIDAVVLDKTGTLTSGHMSVARVTAAPGGLGEEELVRLAGAVEQGSEHPLGRAITAYARRTDPADPLPAVADFVALPGKGVRGRVADRVIEVLAPDDALPFQHTGLAVVLQGLVRPR

SEQ ID NO: 116 - protein, 143 aa, Streptomyces hygroscopicus
MNRAEQVTRSAGEPGVVTRVTTRRRNSGAGRPDSSTGTAGSAEAVRSDREFPHMAQPRPSARRTPGAFLTRALPPPALCGFLLLLVMAFAASYAVGAGAGPVAPGMHGTSTTDGGSGDGGSGDGHGGGGMDMGGMDTDQGSGR

SEQ ID NO: 117 - protein, 327 aa, Streptomyces hygroscopicus
MPACPRRAHLHGGTHLMPLTTAPDTRSTSSMSAAILDLLLPYHRTTDPSPAAAEAFAQQRRQIAGFVRAGEPVVFTLPGFPCKSPNPAKVLGHLPDQGERLSLGFLNTLCEEIERVHPPGARVIICSDGHVFGDLIRVPDDHIDAYADGLRRLIRESGLHRLSVFDLRDVLGDLPHHTKRVQVHERYAPTLEALRAEVRSGDHTLALYRGIIRFLVDDTADFTGTRSALQRECRTRAYGVIQRSRAWGDLIAEHHPGSVRLSIHPQPIGAPKFGIRLLDAADVWATPWHSAALHRTDGTWTLMPRARAEQLGRLVHRDGSPSHYEQG

SEQ ID NO: 118 - protein, 418 aa, Streptomyces hygroscopicus
MTLQESGTTPEALPEPVPLMGCPYKSNPYPLYERMRETGPVHRVRFPSGVHAWLVTGYDAAHSALGDDRLGKNHDRGNDRWRARASIMPEPQHSQLQVHLLHQDPPDHTRMRRLVTDAFTPRRVEHLRPRFQELADTLVDALPETGPADLVTGFAARFPLQVLAEVIGLPPESAARFDRDWGKVVQPVGPTDPGRPLYEARLHGLQSYIAEVVAHKREHGEDDLLSRLVVARDRSELSQEELDSMIFQLLVAGQEPVTNQITTALIALFRHPAELARLRDDPELMPRAVDELLRYDSAFELTTWRFFDQDSDLHGTDVPAGDSVIISLCAANRDPRRFPDPDTLDLDRSPNPHLAFGHGIHFCPGAALARAELQIALGTLLSRLPGAHLAIEDRDIEWIPAVLGRGTNHLPVGYDRRV

SEQ ID NO: 119 - protein, 608 aa, Streptomyces hygroscopicus
MCGITGWVSFHQDPRTQAPVIEAMTATLTPRGPDADGVWLGPRAAIGHRRLAVIDIAGGVQPMTDRPDAPTTVLTYSGEIYNHHELRSQLKGRGHEFRTRSDTEVVLRGYAEWGEEVADHLDGMFAFAVWDERAQRLLLVRDRLGVKPLFWAAVDGGLAFASEPKALFAHPEIRPRVAADGLREAYGLLFNTGPTVWSGVREVEPGGLLLLDRDGIRERRYWRLAADAHPDDRDATVARVHDLVSAAARAQLEADVPLCSLLSGGIDSTVLTALLADELRLREGPGARIRSYAVDYSDQAESFTDDVLRTGHDTPYATEAGAFIGTDHSTVVLDPRALLDPEHRKAVVVARDSPIGVGDMDTSLYLLFGEIRKHSTVALSGEAADEVFGGYPWFHNPKALAASTFPWLLVTGDEAAMPLNPELDLRIGEFRADTYRTALAAVPHLDGETPTEHRQREMQHLSLTRWLRQLLHRKDRLSMAQGLEVRVPYCDHRLVEYAFTTPWTLKNFDGREKSLLRAAGTGLAPDSVLHRPKNHYPATHHPDYNRGLQNMARDALADDTVRSLADETRVKPCLDTPPGQLEWGHRLRLERVVDLALWLDHYQPELAL

SEQ ID NO: 120 - protein, 476 aa, Streptomyces hygroscopicus
MTDDASGADQPGDVTERPADPPEVHDRWLLVAVAGALAFVAMLDMNIVNVALADISQGLRVPAATAQWAVLGYQLPVVALLLPVGRWLDGVGTRPALMAATGGFALCSALAAASPWAAWLIAARIGQGACGAVLFVSMPVLAIRSVRPESRGRAMSVPATLGPLGAVTGPAVGGLLLDQLGWRWIFLVKIPFCLLALAVVWRAMPRDGRLRGADRRFLGDTALIATGVTILLLSLTLASDTPAWLPLALVAAPPLWWWLRGPGGRPVAGVLRAAGLLRAHGAVLALAVGFAAMHYVVALHLQRDEDVSATTTGLTVLAFPLGMGLAGPLGGRLADRYGARPVAVTGAALTAGGLLLLVPLGDGWSPPDVAWRLALAGLGMGLNGGPVQALVMGAAPPGRAATVGSTVQLARSLGFTLGPALATAAWGPAGQDDGVRAGLALAALAACLAVPLLARPARDPANLTEKTTDAAPAAPR

SEQ ID NO: 121 - protein, 267 aa, Streptomyces hygroscopicus
MSAGPALGERELRIDIEDLRVAYAGRTVVADAHLIAAEGEITGLVGPNGSGKSTLLRTVYRHLKPAAGRVLLDGTDIRELSPARSARHVAALPQERGGDFELTVREVVAMGRTPYKRAFAGEDAADRDIVERSLADVGMGDHADRHFTELSGGERQRVLLARAFAQRTDVLVLDEPTNHLDVRHQVELLALLRGRRRTTLVSLHDLNAAASVCDRLHVLHEGRVVASGTPREVLRPALLAEVFGVRAAVVEHPLTGDPLIAFDHREL

SEQ ID NO: 122 - protein, 360 aa, Streptomyces hygroscopicus
MALDATVSGKGTDARARTRRSVPAGPLALLLAVALLAALTAAVAWGSTSIPPGEVWSVVWRRLTGDAPRPGTNDLIVWQLRLPRALLAALVGAGLGLVGTAMQALVRNPLADPYFLGVSNGASLGAVAAIVLGLGAGGALGLGLSGAAFAGALATFALVWAVARRGGGFAPLRLVLAGVAIGQFLSGFTSYLVLQAGDEQQTHSVLFWLMGSLSGASWALLAAPAVAVPAVLLLLQARARGLNALLMGDETAAGLGIDVVRLRRELFAVTSLLTGVLVAVSGAIAFVALMVPHVCRLVVGGDHRRLLPVSALFGALLLVVVDIVCRTAMDTQELPVGVVTSLIGAPALLYLLDRRLGSGS

SEQ ID NO: 123 - protein, 358 aa, Streptomyces hygroscopicus
MRSRVWWGTTAAVLGGLLVAGCGDGGGSGDGDKAGPADEKSATGDYPVTVTDCMGAKTIFSNAPKKIVTSNASSLELLLRLGAGDNVIGTGFPPGKGSLPAELDAQARKVKVLGQSVIPKEKLLGSGADLYIDTFASMNMGGGMGDAPTEEEFKAAGIKHIYLKSTACAARNTRAVTDLSAVEADITSLGAVTGTSAKAKELVDGMKGKVDAVHKAVGRTAEGERPTYFFFDYDAGTKQPTVVCNRQVANAVITLAGARNVFADCDGDYKQVGWEDVISRNPDWIQLGVRDRGSEVANEKAFDEARKWLESNPATKGLKAVEEGHFLRIGSERITIAGVENADAVQEIAKALYPGKVG

SEQ ID NO: 124 - protein, 227 aa, Streptomyces hygroscopicus
MSPGRSDSGGGGHVVSTESVLTFAAMSLLVIVIPGPSVLFVVGRALAHGRRTALATVLGNVIGCYALVIAVAWGLGALVESSVALFMGVKLAGAAYLVYLGVQAFRHRREMRVANMDAPADERRGDLRSILDGILVGVTNPKGIVFFAAVLPQFVDHSVGHVPVQMMVLGLVPITIGLVTDTLWGLGASAARSWFARSDRRLSMVGGAGGLAMIGLGVTVAATGRAD

SEQ ID NO: 125 - protein, 300 aa, Streptomyces hygroscopicus
MDKRTMGRHRRITQPPRTTLATRAVLAAGVLVPTIASAGSAHAATPQAAICTSDRPELADKLSEDINSALEGSAATTAISLHDRTTNTTCTLDADRHFDSASTVKVTVLSTLLWDAQKDNRALTQEEKDHATAMITESDNDATTALWKQLGADKINGFLQAAGMTNTTLDSEGHWGLTQITANDEEKLLQLVTHTNPVLSDDSRAYILKLTAEVIPSQRWGTPAGAPSDAQVHVKNGWLERATNGWRVHSLGAFTGGDHDYTITVLSQDNATMDDGIANIEGIARAVHENLNAPVSSAQS

SEQ ID NO: 126 - protein, 263 aa, Streptomyces hygroscopicus
MTTRVPVAGGSLDVRVGGDMGPTLVFAHYWGGSADTWNGVIGHLPPGQATVRFDQRGWGTSRALPGPYHLDQLADDLVRVIEERVSGPFVLVGHSMGGKAGQLVAARRPAGLVGLVLVAPAPPQPPAMVTEEYRQGLSHAYDSAETVGHALDHVLTATPLPEAVRATAERDSLAAGAEARQEWPLRGIARDITDAARRIEVPVTVLAAENDVVEPPHILREHLLPHIPHATLTTVPDAGHLLPAEAPGAVARALGDFLTAIQS

SEQ ID NO: 127 - protein, 294 aa, Streptomyces hygroscopicus
MENGHSAVRQLRYLPAVGSAYGVEVLDFAALRSMDTQRRRTQPQRPDFHVFALVGSGTGSHEADFHNYRLGEGGAVWIRPGMVHRWSDIDACDGPLILFRPGFLSGFTASEATAPACWHLDRQRLSLALLAAEHLGREHSTAVHTPRLASPVLLSHLLAALILRALPGTPPSVGPASPGSRPTEVFRAYRAAVEERFTDWHHVADYARALGYDVRTLTRTTRAATGTGAKTFLDQRILLEAKRLLAHTDLPVSGCARRLGFRDVGNFTTFFRRQAGLPPAAWRAAYSTAGAQGG

SEQ ID NO: 128 - protein, 253 aa, Streptomyces hygroscopicus
MLSVNTVTPSHLNAPTRLTRGKYIPGAEIYQGQFSATVDAVDGKPGLRERKKQRTHAAISDAAISLFLEYGFNQVSVAQVAEAAEVSKRTLFAYFPTKEDLVVHRLADHETESARVVRARPPRTAPLTALREHFLEGLRERDPITGLNDQPEVRRLHRMILDAPSLVARMAGFKTGAERALTEALRETADTPELTARLAAVQIVAVHWALAQDNAERLAYGEPADERYAGAVADMEHAFALLENGLRHLPPRQ

SEQ ID NO: 129 - protein, 479 aa, Streptomyces hygroscopicus
MLAYELALAGVETLVLEKLPQRIQQVKGGTIQPRTAELLESRGLLEPMLRRAIARDPVGGSFGALPVPLDCAPWRTEHPFPIGIPQWEIEEVLEERATAAGARVLRGTAVSGVAPDDDGVVVTADGLRARAHYLVACDGGHSTVRKLLGLPFPGRAGTHPAVLADIRLSAVSSLVPRQMGLMSTMTRHARGYWSMLVPLGGDRYRFTFGHADQADTARDTPVTHEEIAAALQAVYGPETTLGAVDNSSRFSDATRQLEHYRTGRVLFAGDAAHIHPPLGAQGLNLGVQDALNLGWKLAAVLQDRAPNGLLDSYHAERHPVAAQVLHHTSAQRVLAISNPSEDVAALRDIFTDLLRLPDTNRHLAGLMSGLSLRYDLPGDHPLTGERIPDADLVTETGTTRLSTLFGSGHAVLLDLAGAVPADLPLPPRVDLVRATCADDMGAAALLIRPDGYVCWATDTSAACGDTLLAALTGDLARVP

SEQ ID NO: 130 - protein, 156 aa, Streptomyces hygroscopicus
MTATADYDSLARRLRALEDKEALRALMIRGWRALDRKDWQTWIECWAEDAVLEFGPWEKIHGKEAVRAKVEEVESPYASMQHHILNMHVDVEGDRATGIGYMWFVAVTAPGSTSSPYSMGGPYDWEFRRGPDGWLLVRQRLGVWWTDGEDTLRAFA

SEQ ID NO: 131 - protein, 6842 aa, Streptomyces hygroscopicus
MLRTDLIRPVPELLRANADRFGDKPACSDGHRTVSHAELERRTRRLAGHLAGLRLHPGDRAMICLGNRVEMVESYFGVLRANGVAVPVNPRSTDAELSYLLADSGARLVLTDVAHADQFGRLREQFPELRVVVSGDGPLPKGFIAFEPLPDTEPQLAARDDLGLDEITWMLYTSGTTGLPKGVLSTQRNCLWSLAACYVPVTGLTAEDRVLWPLPLFHSLSHIVCLLAATAVGASTRIVDGVSTADVLDALREERSTFIAGVPTLYHHLIEAARERDFATPELRIALVGGAVATADLVRSFESAFGVPLVDAYGSTETCGAIAVNWPTGPRVEGSCGLPVPGLTVRLVDPDTGVDVPAGREGEFWVSGPNIMAGYHNQPEATASALRDGWYRTGDLGRRDEAGFCTVTGRIKELVIRAGENIHPGEVEAVLRTVPGVADAAVVGKPHAVLGEVPVAFVVPGPDGFDPSALLATCRERLSYFKVPEEIYEIARVPRTASGKITRHVLLELPARLRAAGDGQYDSLLRLDWVPQSALPDAPAGTGTWALADADALGLAVGLRAAGVDARVVGEPVGEPVADSVAGLVAGSVADLAGDDGAAPDVVVVTPPVAGLPDETGAPDEAGVTVGERADRLAARLGAWLADDRLAGTTFVVATTGAVATGAEEDAPEPLSAALWGVVRSLQAAYPGRLTLVDVDLDGAGDRAGDGAGEDGREAALLRAVQGGHDQAAIRGGVLLVPRLTRISFPAEPGPAPTLDAGGLVVITGGDTTRGTALARHLVTAYGARNLLLLSANGLPEEAAATLRTELARDGAQVSMAVCDPADRTALDSVLDAQARPVTAAVHIEEPSPERSLDTSLRAMTHLEERTRGAAPALFVVVTSAAGVLGSPGRPDRAAADQFGEALVRRRRALGLGGLALAWGPLPGEHGTAPVAGAVPLPEALALFDAALTAGQGPLVLLRPSTTGLPGGEPVPAVLRHLVDAPSGVPASDEPAVAEFRRRLAAESESGRQRMALALVREHAAATLGLASADPVEAGQAFSAFGFTSLTAVALRNRLNAATGARLAATVVFDHPTPAGLARHLVREITGRRGVQAPVRARGVSDEPVAIVAMGCHLPGEVATPEDLWRLVADGRDAIAGFPEDRGWDLAGLFDSDPDAVGKSYVREGGFLTDAGGFDAAFFGISPREALAMDPQQRLLLETAWETFENAGIDPGSLHGTDVGVFSGVMYHDYGADAGTAAEGLEGHLGVGSAGSVVSGRVAYALGLTGPAVTVDTACSSSLVALHLAVQAVRTGECSLALAGGVAVMSRPTSFIEFSRQRGLAPDGRCKSFAEGADGTNWSEGVGLVLLERLSDARRNGHEVLAVVRGTAVNQDGASNGLTAPNGPSQERVIRQALANAGLTVADVDAVEAHGTGTSLGDPIEAQALLATYGQERPEDQPLWLGSLKSNIGHAQAAAGAAGVIKMVQAMRHGVLPKTLHADEPTSKVDWTSGAVSLLSEARPWPETGHPRRAGISSFGVSGTNAHVVLEQAPLEAAAPETQASDAGAPGLVATGGVVPWVLSAKTPAALRAQAERLVSHLESGSDANPVDVGWSLATTRAALEHRAVILATDAEGGMATARALAEGRPDPLLVTGQTGTDGKTVFIFPGQGAQWVGMGAQLLNTSPVFAARLRECADALAPYTDWSLIDVITGTPDAPSLERVDVVQPATFAVVVSLAALWQSVGIHPDAVIGHSQGEIAAACVAGHLTLTNAAKIVTLRSQTIAHHLAGHGGMMSLATPADTIDLTNWHGKLWIAAHNSPNATVIAGDTDALHQLHTHYTDQGTRARIIPVDYASHTGHVDTIKNQLQDVLDGITLEPGTIPWLSTVTGQWIEPNTVGDSYWYRNLRQTVQFEHTIHTLADQGYRTYIEISPHPVLTTAIQETLEANDTPNTTIVTGTLRRDDDTPTRLLTNLAHLTTNGTPVNWPTLFTGTQPTRIPLPTYPFQHHHYWLPRNTSAGDVSAVGLQGTGHPLAGAVVSVPDTGGVLLTGQLSVATHPWLADHAVSGTVLLPGTAMAELAIRAGDETDTPTLEELVIGQPMTLPEDGALHVQVLVGGVEDGRRGVRIYSRPDAAQEQEWLEHASGTLATQPDGSAEGGMENGMPEWPPPGVEPIALDDFYDDLAQAGYEYGPAFRGLKAVWKRDGEVFAEAALPEEQTDVAGRFGIHPALLDAALHASNFCVPPAPGQTLLPFVWNGVRLLAAGATAVRVRARATGTDSFTISLFDSTGSPVASVDSLVLRAISPEQLAAASGGAGRSADALFTLDWTEHPTALGTEVSWATLGDAHTDVDAHVDALIAGEDRPGAVVADTAAWAAGDTGLPARARDLAARALDLVQRWVGRPELADVRLVLLTRGAVSVHDTAEVTDPAAAAIWGLVRSAQSEHPGRIALVDTDDVSREALPEAVAAGEPQVALRRGLLWVPRLVRSPQGLAVPAHEHWYLDVSEKGSLENLVLRPDPEATAPLATGQVRIEVRAAGQNFRDVLVALGGVAGQEGLGGEGAGVVTEVGPGVEGLAVGDRVMGLFPRSFGPLAIADARTVAPIPEGWSYATAAGVPVAYLTALYGLRDLGTVQPGETVLVHAAAGGVGMAAVQLARHFGATVYATAHPSKHHVLTALGVPEGHLASSRDLGFASAFPALDVVLNSLTGEYVDASLGLLGTGGRFVEMGKNDIRDPASVAAAHPGVGYQAFDLGGDAGPDRIRELLAELVELFEAGRIEPLPIRHWDVTQAPTAFRWMSQGRHTGKIVLTLPRALDPDGTVLITGGTGTLGATIARHVVTHHGARQLLLISRQGPDAPGATDLTTELTELGATVRITACDTADRDQLAALLADIPAAHPLTAVIHTAGALDDGVLTALTPDRLDTVFRPKVDAVTHLHDLTRDQDLAAFVIYSSAAGTLGNAGQANYAAANAFLDAFAQWRHARHRPATSLAWGLWSDTSTLTSTMDATDVRRTRRAGVLGMDNAEALRVFDTGLRSGRPALVAAKIDLTALRAPDAELSPLLRGLARPARRTARTAAPAAGGLSGQLAGLSPAGQREFLLNLVRAEAAVVLAHAGPEAIEPTVAFKEMGFDSLTAVELRNRLNAATGLRLPATLLFDHPTPALLTELFHTELGGGPAPAAAAPVTVRAAADEPIAVVAMSCRLPGGVTDPDGLWNLLLEERDGIADFPRDRGWDLEALFDADPDRSGTSYVLRGGFLEDAAGFDADFFGISPREALAMDPQQRLFLEACWEVFERAGMDPTTVGGGDIGVFAGVINQDYGVRSGPAPEDLEGYMLTGSATSVASGRVAYVLGLEGPAVTVDTACSSSLVAMHWAVQALRQGECSMALAGGATVMGRPSAFVEFSRQRGLAPDGLCKAFGAGADGTTFSEGVGVLLLERLSDARRNGHEVLAVIRGTAVNQDGASNGLTAPNGPSQQRVIRQALANAGLSATDIDAVEAHGTGTALGDPIEAQALLATYGQDRPGDEPVWLGSLKSNTGHTLAAAGVSSVIKMVLAMRHGTLPRSLYADEPTPEVDWSQGAVSLLTEARPWPETSHPRRAGISSFGISGTNAHLILEQAPQSETEPEAAPKADGGMDTPGLVATGGSVPWVLSAKTPTALRAQAQRLLDHLESGVTDRPLDIGWSLATTRTLHDHRAIILTDTEGGDATAALTALATGQPHPRLTTGHATTHGKTVFVFPGQGAQWQGMGAQLLDTSPVFATRLHECADALAPYTDWNLIDVITGAPHAPSLDRVDVLQPTTFAIMVSLAALWQANGIHPDAVIGHSQGEIAAAHIAGHLTLTDAAKIVALRSQTIAHHLTGHGAMMSVLASHTWVQEALAPWHGHLWIAAVNGPASVSVSGDPDALAEFGVTLSKAKVYRWQLPGVDFAGHSGHVDTIKDQLHHVLDGVTASPGTVAWMSTVDADWANPTHIDAHYWYRNLRDTVRFEEATRALLTHGHRVFIEISTHPVLTTAIQDTTETLPEVRATITGTLRRDDGGPDRVLTSLAELSTAGIPVHWPTAYAGTTPSQVPLPTYPFQHQHYWLAATGHHGDVGSVGLRDAAHPLLGAVVSVPDTGGVLLTGRLAPSAQSWLADHMLSGVALVPGTAIVELAVRAGDETGTPVLEELVLGQPMLLPEDGSLQVQVLVGAAEDDERRAVRVYSRGDESEPWVEHASGILSAHALVPVEAERQWPPTGAEPVVLEGFYDRLAQAGYEYGPVFRGLTAAWTRGDDVFAEITLGEDQHDLAGRFGIHPALLDAALHASNFCPGNEPGGGTYLPFSWNGVQLHADGATALRVRVTSTGPDNLSLHATDPHGVPVVTVGSLVLRETTAEQLRTTSATSAADSQFTVEWTEHPLARDEVAWAALEAVQDDDTWPPVVVADTRAFAAQGGGLPDEGGLQEDGELPERARELTGRALAAIQRLISDDALADSRLTLLTRGGMAVHDDTEVTDPAAAAVWGLVRAAQAEHPGRVCVIDIDDRSAEALTAALATEEPQLALRGGTAWVPRLVRARPGLAVPAAVAWHLDVTEHGTLENLALVPHPRAEAPLEAGQVRIAVRAAGQNFRDVLIALGMYEAEIGTEGAGVVTEVGPGVADLTVGDRVMGMLPGSFGPLVVADRRTVVRMPRGWSFTAAAGVPVAYLTALYALRDLGDVQPGETVLVHAAAGGVGMAAVHLAHHFGATVLATAHPAKHHSLEQLGVPTERRASSRDLAYARTFPTADIVLNSLTGEHIDASLGLLAPGGRFIEMGRTDIRDVDEVRASHPDRTYRAFDLGADAGPDRIQELLAELVDLFEQGLIPPLPTRPWEITRAPDAFRWMSQGRHTGKIVLTLPRIPDPEGTVLITGGTGTLGTAITRHLVTHHGVRNLVLASRQGPNALGAADLHDELTALGAQVRITACDIADRGQLAALLADIPSDHPLTGIVHTAGALADGTLTTLDPDRIDTVFRPKVDAVTHLHDLTRDQDLALFAVYSSAAGILGNAGQANYAAANTFLDAFVQRRRAAGLAGLSLAWGLWAETSDLSAALITANRDRTQHGVVRPMATEHALSLFDSALGLGLSLVVPAKLDPGAHESAAGAVPPLLTGLLRPTRRTLRSTAGQSGEGGLTARLAALSEADQHRLLLDLVRDHTATVLGHAGKDAVDARRAFSEIGVDSLIAVELRNRLAGATGLRLPATVVFDYATPEAMAGHLRSVVAGDTAAPASPSTSAVAPASAVAPADDPVAIVSMNCRLPGKVTGPGELWDLVSQGRDAIGPFPTDRGWDVETLFDLDPDAVGKSYVREGGFLTGAGDFDAEFFGISPREALAMDPQQRLLAETSWELFERAGIDPVSVRGQAIGVFAGVIDQGYIAHSEAPPPELEGYLMTGSTTSVASGRVAYLLGLEGPAVTVDTACSSSLVALHLAVQALRAGECSMAITGGVTVIAKPGGFISFSRQRGLAPDGRSKSFSEGADGTSFSEGIGLVLLERLSDARRNGHEVLAVIRGTAVNQDGASNGLTAPNGPSQQRVIRQALANAGLTVADVDAVEAHGTGTALGDPIEAQALLATYGQDRPGDEPLWLGSLKSNIGHTQAAAGIAGLIKMVLAIRQGTLPRSLHAGEPTTKVDWTSGAVSLLSEARPWPETGHPRRAGISSFGISGTNAHVILEQGPEVAVPATEARDAGAPGLVATGGVVPWALSAKSPAALRAQAERLVSHLESGDAPRAVDVGWTLATTRAALEHRAVILATDTEDGIATARALAEGRPDPLLVTGQTGTDGKTVFVFPGQGAQWVGMGAQLLNTSPVFAARLNECAEALAPYTDWSLMDVITGAPGAPSLERVDVVQPATFAVVVSLAALWQSVGIHPDAVIGHSQGEIAAACVAGHLTLTNAAKIVTLRSQTIAHHLAGHGGMMSVLASREQVEEALTPWHGKLWIAAHNSPNATVIAGDTDALHQLHTHYTDQGIRARVIPVDYASHTGHVDTIKNQLHQTLADTTTEPGTIPWLSTVTGQWIEPDTVDSGYWYRNLRQTVQFHTAITALAHEGYRTFIEISPHPVLTTAIQETLEANDTPNTTITGTLRRDDDTPTRFLTHLAHLTTHGHTPDWTALYSATHPRPTPLPTYAFQHHHYWLTPSEVPEAVADGVFWDAVERGDLASLADSLGVEEKTLEPVLPGLTSWRRRNQDQSTVDTWSYRIAWDPVATGEAPVLPGAWLVAVASPQASDAAVTDVVAALAAHGADPVVVEVDTVEQAEVTARLRERISDSDDEYAGVVSLLAWDERSYEPGTLSRGVAATVALIQAVEEIGLAAPLWCLTRGAVAVREPSEVTSEFQPLAWGMGVVQGLDQPSTWGGIVDLPRTPDETALVRLCSVLAGVDAEDQVAVRASGVFARRMRREPVTSAPAWQPRDTVLITGGTGGLGSYVGRWAAGHGARRVVLLSRQGAQAPGAAELEAELSALGADVTIAACDVTDRDQLAAVLAEIPDDAPLSGVVHAAGLALPEKPLSKMTLAEFADIGQAKIAGARHLDDLLGERELDAFVLFSSGAAAWGSGGQSAYAAGNAYLDGLAQRRRARGLAATSVAWGAWGGGLGTIDEMMGAQWRRTGLMTMDPRLAALAMAHTVGSGTAHGVVADIDWERFAPGYTMARFRPLLRGLPDVIDLLTEDAPEDSAGQTELIARLAGLSPEDQERLLTELVQAEAAAVLGHVSADATGDRPFSEIGFDSLTAVELRNRLNASTGLRLPATMVFDHPRPSVLARRIRTELGHTDTSSVDSVLAELERLEAHLAALPKEKIERARITSRLQRMTTKVAEIEAVGTGGDTVTERLDTANADDVFAFIDQEFGVD

SEQ ID NO: 132 - protein, 3435 aa, Streptomyces hygroscopicus
MANDEKLLNYLKRVTADLHQTRERLRKAEAATEEPIAIVGMGCRFPGGVTTPDGLWDLVADGRDAIAGFPEDRGWNLENLFDADPDSVGTSYVREGGFLTDAAEFDAEFFGISPREALATDPQQRLLLETAWETLEHAGIDPSSLEDSDVGVFTGLANGDYALTVDQVPEGFEGYLGLGGAGSIASGRISYSLGLLGPAVTLDTGCSSSLVAMHLASYALRSGECSMALAGGVMVMATPGGFVGFSRQRGLARDGRCKSFGEGADGTNWSEGVGLVLLERLSEAHRNGHPVLAVIRGTAVNQDGASNGITAPNGPSQERVIRQALANAGLSLADVDAVEAHGTGTSLGDPIEAQALLATYGQNRPEDQPLWLGSIKSNIGHTQAAAGVAGVIKMVQAMRHGVLPKTLHADEPTSKVDWTSGAVSLLSEARPWPETGHPRRAGISSFGVSGTNAHVVLEQAPLEAAAPEVDVDEAGAPGLVATGGVVPWVLSGKTPAALRAQAERLVSHLESGDAPNAVDVGWSLATTRAALEHRAVILATDTEGGMATARALAEGRPDPLLVTGQTGTDGKTVFIFPGQGAQWVGMGAQLLNTSPVFAARLRECADALAPYTDWSLIDVITGTPDAPSLDRVDVVQPATFAVVVSLAALWQSVGIHPDAVIGHSQGEIAAACVAGHLTLTNAAKIVTLRSQTIAHHLAGHGGMMSLATPADTIDLTNWHGKLWIAAHNSPNATVIAGDTDALHQLHTHYTDQGTRARIIPVDYASHTGHVDTIKNQLQDVLDGVTLEPGTIPWLSTVDGQWIEPSTVGDSYWYRNLRQTVQFEHTITTLADQGYRTFIEISPHPVLTTSIQETLEANDTSSTIVTGTLRRDDDTPTRLLTNLAHLTTNGTPVNWTTLFTGTQPTRIPLPTYPFQHHHYWLPRNTNAGDIASAGLHDPGHPLLTAAVHLPDTGGTVLTGRLSLTTHPWLADHTVSGAVLLPGAAMAELAIRAGDETDTPTLEELVIEQPLALPDSGFLDIRVVVGGPDESGRRDVRIYSRAEEETAQWTEHATGTLAQDTTAPPSPAVAEWPPAGAEPVAVEGLYEQMAEGGYDYGPTFQGLKAVWTRDGEVGEVFAEAALPEEQTEAAGRFGIHPALLDAALHASNYCLPGEPGSRMLLPFAWNGIRLHATGATSVRVHARYTEDGGLSVVLVDAAGGLVASIGSLVLREVDAAQLEALTSTSVNDSLWTVTWTEHTATTDEIRWGTVGDVSPVLAAAEAPAFADVTEIATGPAIGMGTEIAGAEERPALVVADTTVWESRDADPITRARELATRALDLLQRWVTLPELSETRLAVLTRGAMAVHDSSEVTDPAAAAIWGLVRSAQSEHPGRVHLIDTDGHSDHALRSALPTALATDQPQLALRDNTLWAPRLTAAAPVGTPAQPLPLDPEGTVLITGGTGTLGALTARHLITHHGARHLLLTSRQGPYAPGATDLTTELTELGATVHITACDTADRDQLAALLANIPAAHPLTAVVHTAGTLDDALLTDLTPQRLDTVFRPKVDALTHLHDLTRDHDLTAFVIYSSATGTLGTPGQANYAAANTYADALAHQRHATGLPATSLAWGLWETTSALTATMNTEDRRRTHRGGVAPLTDDEGLVLLDTALTATHHPHLVPIKISPASLRADDTARPVPPLLRHLVRRPTRRTAHTPAPADTLSLTRRLAALDHGERLRHLIELVRTEAAAVLGHPTIDSIGPDQPFRDAGFDSLTAVELRNRLNTATGLRLPATVVFDYPTSAITAGYLRDELFGSTEAAPAAVAGRGADADDPVVVVGMACRLPGRVTDPDGLWRLVADGEDGIGAFPTDRGWDLDTLFDPDPDRVGATYVREGGFVAGATEFDADFFGISPREAVAMDPQQRLLLETAWETFEQAGIAPRSVQGTDTGVFAGVIYHDYGTNAGELPEGSETYLSTGKSGSVVSGRVAYALGLTGPAVTVDTACSSSLVAIHWAAKAVREGECSMALAGGVTVMSTPEGFVSFSHQRGLAPDGRSKSFGEGADGTTFSEGVGLVLLERLSEARRNGHEVLAVIAGTAVNQDGASNGLTAPNGPSQQRVIRQALANAGLSATDIDAVEAHGTGTALGDPIEAQALLATYGQNRPADQPLWLGSLKSNIGHTQAAAGIAGLIKMIQAMRHGMLPRTLHADEPTTKVDWTSGAVSLLTEARPWPETGHPRRAGISSFGVSGTNAHLILEQAPEDAATAPEITEPEAPGLVATGGAVPWVLSAKSPTALRAQAERLIAHLHAHPEIDPVDMGWSLATSRAALEHRAVVLATDLDQATAALTALSEGQPHPGLVTGETGSDGKTVFVFPGQGAQWQGMGAQLLNTSPVFATRLHECADALAPYTDWSLIDVITGAPGAPSLDRVDVLQPTTFAIMVSLAALWQANGIHPDAVIGHSQGEIAAAHIAGHLTLTNAAKIVTLRSQTIAHHLTGHGAMMSVLAPHTWVQEALTPWHEHLWIAAVNGPASVSVSGDPDALAEFGVTLSKAKVYRWQLPGVDFAGHSGHVDTIKDQLHHVLDGVTASPGNIAWMSTVDANWTNPTHIDAHYWYRNLRDTVRFEEATRALLTHGHRVFIEISTHPVLTTAIQDTTETLPEVRATITGTLRRDDGGPDRVLAGLGGLFAAGVPVDWGALFASTGARRVPLPTYAFQHRHYWLEPARTPTRAESADGSLWAAIEDGDAQSLARDLDVDAAALGTVLPALASWRRRSREDSLTDAWRYRIGWTRVATADPQLSGRWLVLVPAVRAGSARVRAVLDGLAARGAEVVAAEVSETGREALGDQVKSADGGAGVVSLLSWDDRADTEYGTVSTGTAATLAVAQALRDHGVTAPLWCVTSGGVAVAGEAADPVQSAVWGFGAVLGLDHPDTFGGLIDLPAEGEGDDEALPDGLFAALSSPEGEDQLAVRADGLFARRMVRDRDGSGSPWKPRGTVLVTGGTGGLGSHVARWLATSGADHVVLLSRQGGDAPGAAELVADLAGVEVTLAACDVTDRDAVAAVLAEAERTHPLTAVVHTAGAGLPSAPVTEVTTEEFAAVTGAKVRGALVLDELVGDRELDAFVLFSSGAGVWGSGGQAPYAAGNAFLDGLAARRRAHGLAATAVAWGGWGGGLGMIDADGGDQWRRIGILPMDPAPALRALARAVGGGLPNVIVADVDWARFVPGYTMARERPLLRQLPEVAEILAADTQGGGASRREVLLGSLAELTGPEQEVFLTDLVRREAAAVLGHADGDAVEPERAFKDTGFDSLTAVELRNRINTATGLQLSPTVVFDYPKPTTLARRLRTELVPTVNGDVDGDGTADGGAAGADGREREIRRVLASVPLRRFHELGVLDALVRLADSAAGDLSGLRDLGDLGDLGDLGTAAEAETSALAELDADELVSRAMRGTTFGND

SEQ ID NO: 133 - protein, 3896 aa, Streptomyces hygroscopicus
MAASREDLVKALRTSLMDAERLKRENDRLIAESTEPVAIVAMACRLPGGVTDPESLWELVDEGRDAIGPFPTDRGWDLETLFDSDPDAVGKSYVREAGFLEGAGGFDAAFFGISPREALSLDPQQRLLLETAWETFERAGMDPRSVEGRDIAVFAGGSGQGYGGGPGEAPKGLEGYLGVGASGSVISGRVSYTLGLTGPAVTVDTACSSSLVAAHLAVQALRSGECSMALAGGVAVMGQPTAFVEFSRQRGLAPDGRCKSFGAGADGTTWSEGVGLVLLERLSDARRNGHEVLAVIRGTAVNQDGASNGLTAPNGPSQERVIRQALSNAGLTVADVDAVEAHGTGTALGDPIEAQAVLATYGQSRPEGRPLWLGSLKSNIGHAQAAAGIASVIKTVMALRHGRLPKTLHAEQPTSQVNWTSGAVSLLAEARAWPETGHARRAGISSFGVSGTNAHVILEQAPEEAEATGENTADQEPPVRSAESADPGPVATGHVVPWLLSGHTQEALRAQAARLLTQVRETPSDSPRDVGWSLATTRTRLDHRAVVLCADAEQAVAGLEAVASGTSARSAVTGSVASGKVAVLFTGQGSQRAGMGRELHGAHPVFARAFDAVCAQFGDLRDGDDKVSLAEVIFAEEGSATAALLDRTEFTQPALFALEVALFRLVESWGVRPAYVLGHSIGEVAAAHVAGVLSLPDACTLVRARGRLMQQLTATGAMVAVEAAEDEVAPLLAGKEHKVSIAAVNGPASVVVSGDEDVVTAVAETLARQGRKTKRLVVSHAFHSPHMDGMLDAFREVASRLAYAPPRIPVVSNLTGAVADPEELCSPEYWVRHARGAVRFLDGVRTLADEGVRTHLELGPDGVLTAMGQDCLPEADAAFVPSLRPGVQEPHAVLAGLAGLYVRGVRVDWDAMFAGSGARPVALPTYAFQHEHYWLERAAGSGDVGAVGLGEAGHPLLGAVVQLPETGGVQLSGRLSVRAQPWLGEHVISGAVLVPGTAMVELAVRAGDETGTPVLEELVIGQPMVLPGDTALSVQVVVGADEGGRRTVRIYSRTDGGTDWTEHATGTLAAQGPAPLDGAAGGAAVEWPPAEAEPIPVEDFYRSLVDAGYAYGPAFRGLVAAWRRDGEIFGDVALPEASVAEAERFGIHPALLDAALHAGSFCLPSDPARQVTLLPFAWNTVRLHAGGASAVRVHVRPVGDDAFSVRLTDGSGQTVASVDSLTLRAVDPAQLKIGTADDALWTVRWSETSLPDGAVSWAPLGESATGATGGYGATGDGGGPGGALPDVLVADTRAWAEDLTGPPTARARELTGRLLEEIQRWVADDAMAGTRLAVVTRGAVAVHDDTEVTDPAATALWGLVRSAQAEHPGRVALVDADGACEELPAGVWSGDEPQLAVRGGAVWVPRLTRVEPGLRVPAQASWHLDSAEYGTLDNLALLPDEAEPAPPAAGQVRIEVRAAGLNFRDVLVALGMYPGRSVIGTEGAGVVTEVGPGVTGLAVGDRVMGLFSGSFGPLATADARTVIRMPEGWSFGTAAGVPVAYLTALYALQDLGRVQPGETVLVHAAAGGVGMAAVQLAQHFGATVLGTAHPSKHHALHRLGVPAERLASSRDLAYADTFPTADVVLNSLTGEHIDASLGLLNPGGRFLEMGKTDLREPGEVGARHPEVTYRAFDLGGEAPAERVRELLHQLVELFEAGRIEPLPVRQWDITRAPEAFRWMSQGRHTGKIVLTLPRALDPDGTVLVTGGTGTLGATIARHLLTQHGARHLLLVSRRGPDAPGATDLTTELTELGATVRITACDTADRDQLAALLADIPADHPLTAVVHTAGTLDDGVLTALTPDRLDTVFRPKVDAVTHLHDLTRDHDLAAFVVYSSAAGVLGGPGQGNYSAANAYLDGLAQWRRAHGLPATSLAWGMWAQTSGMTAGLGSGDLHRVRRGGIVGLSTAEALDLFDRSVASGLSLLVPLRLDIAALGAEAAEPPPLLRGLVRPARRTARPVPKAGEGGLAERLAGLSAAEQERLLIELIREQAASVLGFPTVDPIGPEQAFRDMGFDSLTAVELRNRLNTATGLRLPATLVFDHPSPLATAEFLRDQLGGRAVEAAPRPARRDRSAPDGAEDPVVVVGMGCRLPGDVRSPEDLWRLIATGTDAIGPFPQDRGWDLAGLFDSDPDAQGKSYVREGGFLTDAGGFDATFFGISPREALSMDPQQRVLLETAWETLERSGIVPTSLRGQEVGVFVGASGQGYGTGPGAAPEGLEGYLGVGGATSVASGRVSYTFGLTGPAVTVDTACSSSLVALHLAAQALRSGECTMALAGGVAVMGQPGAFVEFSRQRGLASDGRCKSFGEGADGTNWSEGVGLVLLERLSDARRNGHEVLAVIRGTAVNQDGASNGLTAPNGPSQQRVIRQALANAGLTVADVDAVEAHGTGTALGDPIEAQALLATYGQDRPGDEPLWLGSLKSNIGHAQAAAGVASVIKMVLAIRQGTLPRSLHINEPTTQVDWTSGAVCLLTDARPWPETGHPRRAGISSFGVSGTNAHLILEQAPQPEPEPASKADEGTDTPGLVTTGGTTPWVLSAKTPAALRAQARRLLDHLESDMDAHPVDIGWSLATTRTLHDHRAVVITDTEADSDEAAAALTALATGQPHPRLTTGHATTHGKTVFVFPGQGAQWVGMGAQLLKTSPVFAERLHECAAALAPYTDWSLIDVITGTPDAPSLERVDVVQPATFAVVVSLAALWQSVGIHPDAVIGHSQGEIAAACVAGHLTLTNAAKIVTLRSQTIAHHLAGHGGMMSVLTSREQVEEALTPWHGKLWIAAHNSPNATVIAGDTDALHQLHTHYTDQGIRARIIPVDYASHTGHVDTIKNQLHQTLADTTTEPGTIPWLSTVTGQWIEPDTVDSGYWYRNLRQTVQFEHTIHTLANDGYRTFIEISPHPVLTTAIQETLEANDTPNTTITGTLRRDDDTPTRFLTHLAELSTRGTPMDWPTAYTGSQPSQIPLPTYPFEHETFWLDRGGPGDVRAVGLEDTGHPLVGAVVSVPDTGGVLLTGRLSLRSHPWLADHAVSGTVLLPGTAMVELAVRAGDEADTSTLEELVISRPMTVPDEGTLHVQVLVGGEDRGRRKVGVYSRPEGTRQWTEHATGTLTGRATGTLTAGATAPPPEAAQPWPPEGSEPVALEGFYEHLAEVGYEYGPAFRGLRAVWKRDDEVFAEVSVPEEQTGVAGRFGIHPALLDATLHAGNFCFQSDGERPTMLPFAWTDVRLHAVGATTVRVRATVSDGDGLCVRISDPQGVPVATIGSLQLRETTPDQLRALSAASGGNALWAVDWAECGLDATEARWATLGESRLPDSPPSYPDLSTAVEAVESAEAGERPAVLVADVSAWVPEKTGPIDRTHALCARVLDLLRQWVDRRELADTHLVVLTHGAMAAHDTAEVTDPAAAAVWGLVRSAQSEHPGRIRLIDIDDHSHQALPTALATTEAQLALRDATAYTPHLTPAPATTPEPLTLDPEGTVLITGGTGTLGALTARHLITHHHARHLLLVSRQGPDAPGATDLTTELTELGATVHITACDTADRDQLAALLADIPAAHPLTAVVHTAGTLDDALLTDLTPQRLDTVFRPKVDALTHLHDLTRDHDLTAFVIYSSATGTLGTPGQANYAAANTYADALAHQRHATGLPATSLAWGLWETTSSLTAGMTATQQQRTRDSGVVPLTDADGMRLLDTALATRHPHLVPLELDLAALQNNTGPHTLPPLLRTLIRGHHRPTAHTTAQPEDDAPSLAEQLAALDPTQRHQRLTALVRAEAAAVLGHPTPDAVGPDDALFEIGFDSLTAVELRNRLNAATGLQLAAAMLFDYPTPSMAAEHLQEQLALDAATTETHVAAREAAEDDDQSTER

SEQ ID NO: 134 - protein, 257 aa, Streptomyces hygroscopicus
MFDVAKYLRRIGVEGTPPPTLDTLRHLHKRHLMAVPYDNSTAPDRLPASRHLTNVPLDLVFGHVVTEGHGGVCYELNRLFHTLLAELGYDVRMVAAAVRQANGTFGPEREHTFDLVHLDGRTHLVDVGFPGPSYSEPLYLSEEEQHQYGCSYRVTEHDGYRVVERRPKGSDWQPVYRFRPELADPSGWDAVRLDSLDDYAQDSVLAGTTFRSRATDNGKIVLIGRRYFTVEDGVERTKVLVKADEFQDVVDLILAGA

SEQ ID NO: 135 - protein, 545 aa, Streptomyces hygroscopicus
MTGKEAAVDTARETDSLEAEVLIVGYGPVGQLLSVLLAQRGRRVTVVERWPEPYRHPRAVGFDSEAARLLASAGIGDSLDKFTEPARDHAWQNTKGETLIDHEVADRGHCTWPEALSAYQPALESALIEHGETLPPLRILRGYEAVGLADDGDHVTLTVVGPDGEKTDLTALWVVGCDGANSLVRTGVGTTMTDLDFSYDWLICDVRLHEHREFRPNNLEICDPARPRTAVSAGPGHRRYEFMRVPADDPEHFGTVESAWELLRLFDVTPENGVLDRHAVYTFQARWAERWRTGRMVLAGDSAHLMPPFAGQGMCSGFRDAANLAWKLDLVLGGHAAPTLLDTYTTERRAHVRHAVEMSVGLGRVVCMADPAAAADRDAAMLAARKRNIGPSAARRSVVRPLVDGLLRQDGQGRPAPYAGQAGPQWRVCRAGTTGLFDDVVGTGFVLLYAEDVFPALDARRLTFLDSIGTRLVRMVPADTPPAALGPRDALDVEDRYLSYLSEMDALAVLVRPDFYLFGIAEDEGELLSLVDDLATQLSPSPTPS

SEQ ID NO: 136 - protein, 682 aa, Streptomyces hygroscopicus
MLVLGLNGNFSAADTDVVPQLGEVFFHDSAASLIRDGELVAAVEEERLNRIKKTTKFPLNAVRECLALAGARPEDVDAVGYYFPENHIDTVLNHLYTEYPRAPLRYSRELIRQRLKEGLGWDLPDEKLVYVPHHEAHAYSSYLHSGMDSALVLVLDGRGELHSGTVYRAEGTRLEKLADYPVPKSLGGLYLNATYLLGYGFGDEYKVMGLAPWGNPETYRDTFAKLYTLQDNGEYELHGNIMVPNLVSPLFYAEGFRPRRKGEPFTQAHRDFAAALQETVEKIVLHILEYWAKTSGHSRLCFGGGVAHNSSLNGLILKSGLFDEVFVHPASHDAGAGEGAAYAAAASLGTLERPGKRLLSASLGPALGGREQIRARLADWAPLIDVEFPDDAVETAAGLLAEGQVLGWAYGRSEFGPRALGHRSIVADARPEENRTRINAMVKKREGFRPFAPVVTAEAARDYFDLSGADGNHEFMSFVVPVLPERRTELGAVTHVDGTARVQVVSAESGERFHRLVRRFGELTGTPVLLNTSFNNNAEPIVQSLDDVVTSFLTTDLDVLVVEDCLVRGKASPDLGVLVPRFRPVTRLVERRTAGPDASAGAKTHEIHLDYDGGPSAKVSPELYELLGAVDGTTTLGDLAKTVGGLSDALATEVFALWEQRFLTLAPAGDIGPLADDGTRGH

SEQ ID NO: 137 - protein, 370 aa, Streptomyces hygroscopicus
MTEGKPVSEPPTAVKCLVWDLDNTLWRGTLLEDGEVLPFEWVRDVITTLDERGILQSIASKNDHDHAWERLEALGLAEYFVLPHIGWGPKSASLRAIADRLNFADRAMAFVDDQPAERAEVTYRLPEVRCYAAEDLAGLTRLPEFSPAVVTVDSRQRRNMYQSGFRRDAERAEFSGPDEDFLRTLDIRMGISRATERELSRVEELTLRTSQMNATGVHYPDSALRGLLTDPAHEVLVITMADRFGPHGAVGIVLLERHPAVWHLKLLATSCRVVSYGAGSTLLSWLADQAAQAGVHLAADFRRTDRNRMMEVAYRFAGFADTTCACTVALAVPDEEGVERLHLTPACQPAPTTLRLTAPELADAALPRSR

SEQ ID NO: 138 - protein, 370 aa, Streptomyces hygroscopicus
MTDAATSHTELVSGLIGDRADAWDLAGELPRDLLVKLGASGVLCAQVGAEHGGTGLDSHANGELTAAVGARCSSLRSVMTSQGMAAWTVRRLGGAEQWGTFLPRLTSGDLAAVGFSEPGAGSDLAAMETEIADDGTHVVVTGRKVWITAAHYADLLVVFGKYRGGAAAVVVPAQAPGVRITRVPDPLGCRAAGHADITLDAVRVPAGHVLGGTGLPLPLATTAALTYGRMSVAWGCVGILRACLDAAATHTASREQSGRKLAEHQLVARHLAELYVAERHATRACEHASASWDTGSPDMAVDAVHAKYVASREAAEGAARAVQLLASAAASDGHVVARAYRDAKLMEVIEGTSEICQLVLAQHTRKKVQA

SEQ ID NO: 139 - protein, 91 aa, Streptomyces hygroscopicus
MTISSEPGSHTAETVAQEVQQFLEQRTKQTWDPDTDLFGTGAVSSMFAMELVVHLESTFDVVITGPDLALDNFRTVNAMTTMVLRLRGAQP

SEQ ID NO: 140 - protein, 288 aa, Streptomyces hygroscopicus
MSGDAEAPRLTVLGAGTMGLGITSLVVGHGIPVTVVEVDEAKAGRTRAAVTERLRMAQLMGALPAGRPQGELTVTASLADGRNATAVVEAVTEDTPTKAKVLEAVAGLTGARVPLISNTSSIPIDELAGHIADPARLVGTHFMNPPYLIPTVEVIRGPRTGEAVMTAVTDLLRALERKPVVVGDGPGFVTSRVLHPMINDAIRVVQEGTATVEAVDVLMRDCLGHRTGPLRTADLIGLDNLADSLRVLQLRTGDARCAPCELLLKKVRDGHLGRKSGRGFYAYGKELA

SEQ ID NO: 141 - protein, 218 aa, Streptomyces hygroscopicus
MAQQVDVTEEILGYVRELSLRDDEILAGLRAQTAGLPAAQAMQVMPEEGQLLGLLVRLVGARSVLEIGTFTGYSTLCMARALPADGTLVTCDITAKWPGLGRPFWERADVADRIDVRIGDAKETLAGLRREGREFDLVFIDADKTGYAHYYEESLAMLRRGGLIVLDNTLFFGRVTDPAAQDADTAALREVNKLLREDGRVEISMLTVGDGITLAVKR

SEQ ID NO: 142 - protein, 926 aa, Streptomyces hygroscopicus
MPYSYAMPLNTESNSRPMGGVLHTAAYLGHPFGDSLVRPGQALLVDGPLACGKTTLLRSFAERASEAGYLTVTATCSPSERDLPFGVVSQLARGAWKSPGGLPEVPGLPDILRAAGDPLDQAGIARLCHRLCTSLIDHAEHTPLLVAVDDVRHSDAASAHFLLQLVRRLDSARIAAVFTDDLSLPSSLPLRYELLRAQHLRRIGLGPLSPGQVAEVVVAELGETARRHVGDICAATGGNRLLLHTLLSDYREHGEASQAGYGQSFLSCLHRNEPIFLDVVRALAVVGSALPAADLAWMTGHEPEPISQVLAALTGAGLMDEGEFRQEAARLSVLNDMPAQARRTLHQRAARLLHDQGRPATAIARHLVRAGQIPDSWSAEVLLEVAEQVAVGEEASIAVDLLEQSFEQCPHEERRAALQAKLAGAEWKINPSTATRHHAPLYAAVRAGRLGLPDSVTLLMQLLWKGGLSEVEGLLAHLREDPAATDQLHAIEAALTCTYPWLAERRAAPAHHGGSAATRAAVWPRAGTVLADVLTGGQTHDTVRRAEEVLRELQLGHDPACHEQAGLFALLALVYGGRNDLASAWCEGALGETGGGPHVPMRQAVLSAARSEIALRRGDLAEAAEQSRAALTHASPGAWGVAIGLPLGALILACTRMGRHEEAGFHVAQTVPNAMFKSSYGLHYLYARGHYFLAAGRHQAALADFLLCGELLTDWGLSSGCDPVPWRIGAAEAWLAQGNHDQARILVYQQLSRPHTDGARARGQSLRLLAATSSAKRRPQLLNEAVGLFTEQEDKYELARTLWDLSQAYHALGEKKQARRTMRRAWHVAKMCDAASLYEEWLPADDQHHATAPTPKSDTAIERLTHSERRVASLAAMGYTNREIAGKLYVTASTVEQHLTRVFRKLDIKHREQLPTELYVDRPELA

SEQ ID NO: 143 - protein, 354 aa, Streptomyces hygroscopicus
MTTSTSSPAASSASPARQVVVGLAERSYTVHIGHGVQRLLPQVVAALGARRAVVVTARPAEQTPDPGVPSLVVPARDGEAAKDLAAVTDLCRRFVGFGLTRSDVVVSCGGGTTTDTVGLAAALYHRGTPVVHVPTSLLAQVDASVGGKTAVNLPEGKNLVGAYWQPAAVLCDLEHLKTLPEREWRNGLGEIARCHFIGAPDLDGLPLLDQISASVTLKAGIVAADERDSGLRHLLNYGHTLGHALERATGFALRHGEGVAIGTVFAGRLAGALGRIGPERVAEHHDVVARYGLPTALPPHVSVSELVELMRLDKKATDGLTFVLDSPAGPGLVRGIAEDTVGATLAAMPRAPAW

SEQ ID NO: 144 - protein, 64 aa, Streptomyces hygroscopicus
MKVSVDQEKCCAAGHCALAAPEVFDQREEDGTVVLLDPRPPLALRDSVAEASFLCPAAAIAVED

SEQ ID NO: 145 - protein, 397 aa, Streptomyces hygroscopicus
MDEIRDYPESRAAACPFSPPLGYEELRERSAVTRVRMWDGSTPFLVTGYHEARAALGDSRFSADGTHKAMPRFVKFEVPAEVFNLGRMDDPEHARIRRMLTANFTIRRTEAMRPMIQGIVDGLLDRLIAQGPPADLVADFAFPLPSQVIGVMLGVSDADFAEFQQASQGVMDFTASAEEMGAALGVMVDYVARMCAAKRADPGDDLLSRLIVDQELTGGLTQQQVVATALVLLLAGHETTANMIALSTVLLLSHPEQLARLRADAGLMGNAVDELLRYITIVQEGTGRVATEDVEVGGVLIPGGEGVIINLPSANRDPHFADAHELDLSRPNAREHVAFGFGVHQCLGQTLARVELQIALETLLRRLPTLRLEVPFDDLAFLYESMNFGVARVPVAW

SEQ ID NO: 146 - protein, 962 aa, Streptomyces hygroscopicus
MTAEINSSLRRTPPQRGLMSMGLTDYQFELRDVLDAAARGNGGLLQVTGGPGVGKTSLLGCLKEQAAESGAVCLTASGFADDTAIPFNIVERLIWSSAFMGELDVVARWRTAGERYSEAEPGMLRSLVREISDVLHRIAGGKQLIIAIDDAEHADYPSLMCLLYIARHASGTRTLVVMTGGQTHPLCAPTHGFHEFYKIKIDTLPESGVGYLLERHSDADLADRIRASCHAVSGGNPRLVKALLRDHLQAAPGGPETAVTVGAEFQEAYRGCLLSHPALLQVAQALAVLDRYGSPWRVANLLECGQERAARAITIMNSAGLLEDGRFRHPAARYATLETLPAEDRARLSAKAAELLYADGADPIAVAELLVTADKTPDQKGVTVLWHAAQKNLDHGRTEEAIAGLRLAARADLGRREHMDILMALVGALWSSNPATAEPELDRLLAAIREEFPADIPERYLCFLLFMVLWFGRFSDGEEAFKWLSGGGDTDNASSMAALRVTRQWATFLKPTLIHDFPDQPLSDGEVDGLWAANLEHGLQLSVGELGMEIGHFQDPRQVADFSPDAMHLLSPSNHFWFAYAYACRMVWALAARGEAETADRLCGALFTAADKLNMKTPGAVALSMRAYIRCRRGDFTSAIDFAGTALNSIPPRGWGVAIGLPLSVLVAAHTAIGRLDEAERYLRYWVPKEMFDSVVGLEYLRARGQYCLATNRSYAALSDFMVSGMLMDQWPVDFGDLAPWRIDAAEAYLHVQEPAEAKRLALEELKLSPDRPLSTRGRALRVLAMAEDPDKRRLLLYQSAKCLREHGDRFELARTLAELSQDFLSTGETQQARTTWHEAQKLMDECGISAQHESRRDLVVDGAESSVDARLSEAAGESEEREPGASAEGAEQPVISEAEWRVATLAASGMSNRQIAKSLYITVSTVEQHLTRIYRKLSVGNRQELSRRLWLLIGATGSSSC

SEQ ID NO: 147 - protein, 349 aa, Streptomyces hygroscopicus
MTASAHPHTRVMVELGDRSYPVDIGPGVRHALSGVVAGLGAQRVAMVSARPDGWLPDPGVPSMVLRARDGEADKSLATVEELCREFVRFGLTRSDAVVSCGGGTTTDVVGLAAALYHRGVPVVHLPTSLLAQVDASVGGKTAVNLPEGKNLVGAFWQPSAVLCDTDYLETLPAAEMLNGYGEIARCHFIGAGDLRGLALAEQIAASVALKASVVSADERDSGLRHVLNYGHTLGHALEIVTDFRLRHGEGVAIGTVFAGRLALALGRIDEARAAEHLEVVRGYGLPFALPADADPGRLIEVMRLDKKATDGLTFVLDGPGGPELVSGLAEETVATTLAGMDRAGSDNRR

SEQ ID NO: 148 - protein, 265 aa, Streptomyces hygroscopicus
MTSGDPTLDLDLLAHHVTELCTGAPERLTGVGVAMPATLDATGTVTAWPGRPGWAGVDLGGALSVLFGDAEVRCADDGDLAALAEAHEAGCPDLLYLGVGTGIGGGIVLNGKPVPGLGRGSCEVGHLVVDRDGPLCDCGRRGCVQAAASGPATLRRAARRRGEDVTFAALRQAVADGKPWAMAALRESGRALAAAVTGVCELVHPALVLIGGGFAAAMPELVAMVAERTAALGRPGHPMPPVRPARLGGLSSLHGAVLLARGLPD

SEQ ID NO: 149 - protein, 149 aa, Streptomyces hygroscopicus
MARCALSRLLLVNGPNLGILGKRQPEIYGTDTLQDIERWVGEEVAERGWKVDSYQFDGEAEIIHTIQGNYDTVGAIINPAALMMAGWGLRDALANYPRPWIEVHLSNVWAREQFRHESVTGPLAAGVIFGLGALGYRLAARALLEKVPD

SEQ ID NO: 150 - protein, 388 aa, Streptomyces hygroscopicus
MSNDVRLGSELPAWPQYGDEEREGLIRALDQGQWWRIGGGEVDAFEAEFAAAHGSEHALAVTNGTHALELALEVLGIGAGTEVIVPAFTFISSSQAAQRLGAVAVPVDVDPDTYCIDPSAVEAAIGPRTRAIMPVHMAGQMCDMDALGKLSADSGVPLIQDAAHAHGAQWRGKKVGELGSVAAFSFQNGKLMTAGEGGAVLFPDAEMYERGFVRHSCGRPPSDRGYFHRTSGSNFRLNEFSASVLRAQLGRLEDQITTREQRWPVLSRLLAEIPGVVPQSRDDRGDRNPHYMAMFRVPGLTEERRAKIVDLLIERGVPAFVAFRAVYRTDAFWEMAAPDLTVDELARRCPHSEALTRDCLWLHHRVLLGSEEQMHEVAAIVADVLASS

SEQ ID NO: 151 - protein, 360 aa, Streptomyces hygroscopicus
MVGLGWAARSIWLPRLRRNPAFTVIAAVDPDERGRAAAAEMEGADRLPVLAAVHDLDPAEVDLAVVAVPNHLHCDVATELLAKGIPVFLEKPVCLTSEEAERLAAAERSGGAVLLAGSAARYRADVRGLYRIAARLGRIRHVELAWVRARGVPDRGGWFTQRSLAGGGALVDLGWHLFDIAVPLLGTAAFRHAIGTVSSDFITQRSSRAAWRGDDDGPVLSGGTDVEDTARGFLVTDDGRSVVLHASWASHEALDTTRVTIDGSAGSATLHCTFGFSPNRLEKSTLTRTVDGTTRPVAVPTEPIGTEYDRQLDMVPAQLRDPAGRGRVIEEVRRTIGAIERVYTSARIPQEVRESVSAPV

SEQ ID NO: 152 - protein, 231 aa, Streptomyces hygroscopicus
MTSHPISHGAPLSGASTAPVTSVVFDLDGVLVNSFAVMREAFTLAYAEVVGEGEPPFEEYNRHLGRYFPDIMRIMGLPLEMEAPFVRESYRLAHLVEMFDGVPELLSELRHRGLRLAVATGKSGPRARSLLDTLGIRGQFHVVLGSDEVARPKPAPDIVLKAMDLMDADPDRTVMVGDAVTDLASARGAGITAVAAMWGETDEKTLLAAEPDVILHKPAELLALCPEVTAP

SEQ ID NO: 153 - protein, 210 aa, Streptomyces hygroscopicus
MPSATLPAAPMRAMHGFTTAANDRQVTAWALAARDGDRDAVDHFIRATYRDVRRFVLHLSADPHGCEDLAQETYLRALTGLSRFAGRSSARTWLLSIARRVVVDRYRMTAARPRTLESDDWQEVAERAQPVGLPGFDEGVALMDLLAGLAPARREMFLLTTVLGLPYADAATATGCPIGTVRSRVARAREEITALLAAAEKAAEPVRLAG

The invention claimed is:

1. An isolated polypeptide comprising a geldanamycin polyketide synthase module, wherein said polypeptide comprises:

(a) the acyltransferase domain encoded by nucleotides 27,864 to 28,908 of SEQ ID NO:1; and/or
(b) the dehydrase domain encoded by nucleotides 56,663 to 57,128 of SEQ ID NO:1.

* * * * *

UNITED STATES PATENT AND TRADEMARK OFFICE
CERTIFICATE OF CORRECTION

| | |
|---|---|
| PATENT NO. | : 7,189,549 B2 |
| APPLICATION NO. | : 10/461194 |
| DATED | : March 13, 2007 |
| INVENTOR(S) | : Richard C. Hutchinson et al. |

It is certified that error appears in the above-identified patent and that said Letters Patent is hereby corrected as shown below:

Column 1, line 20, before the heading "REFERENCE TO SEQUENCE LISTING", insert the following:

-- STATEMENT REGARDING FEDERALLY SPONSORED
RESEARCH OR DEVELOPMENT

This invention was made in part with government support under SBIR Grant No. 1 R43 CA/GM96262-01, awarded by the National Institutes of Health, Department of Health and Human Services. The government has certain rights in the invention. --

Signed and Sealed this

Ninth Day of February, 2010

David J. Kappos
*Director of the United States Patent and Trademark Office*